US007718632B2

(12) United States Patent
Van Heeke et al.

(10) Patent No.: US 7,718,632 B2
(45) Date of Patent: May 18, 2010

(54) RNAI INHIBITION OF ALPHA-ENAC EXPRESSION

(75) Inventors: Gino Van Heeke, Upper Beeding (GB); Emma Hickman, Horsham (GB); Henry Luke Danahay, Horsham (GB); Pamela Tan, Kulmbach (DE); Anke Geick, Bayreuth (DE); Hans-Peter Vornlocher, Bayreuth (DE)

(73) Assignee: Novartis AG, Basel (CH)

( * ) Notice: Subject to any disclaimer, the term of this patent is extended or adjusted under 35 U.S.C. 154(b) by 0 days.

(21) Appl. No.: 12/140,112

(22) Filed: Jun. 16, 2008

(65) Prior Publication Data

US 2009/0156529 A1    Jun. 18, 2009

(30) Foreign Application Priority Data

Jun. 15, 2007 (EP) .................................. 07110376
Aug. 13, 2007 (EP) .................................. 07114265

(51) Int. Cl.
*A61K 31/70* (2006.01)
*C07H 21/02* (2006.01)
*C07H 21/04* (2006.01)
*C12Q 1/68* (2006.01)
*C12N 5/00* (2006.01)

(52) U.S. Cl. .............................. 514/44; 435/6; 435/375; 536/23.1; 536/24.1; 536/24.5

(58) Field of Classification Search ........................ None
See application file for complete search history.

(56) References Cited

U.S. PATENT DOCUMENTS

| 4,426,330 | A | 1/1984 | Sears et al. |
| 4,534,899 | A | 8/1985 | Sears et al. |
| 4,837,028 | A | 6/1989 | Allen et al. |
| 5,013,556 | A | 5/1991 | Woodle et al. |
| 5,213,804 | A | 5/1993 | Martin et al. |
| 5,225,212 | A | 7/1993 | Martin et al. |
| 5,264,221 | A | 11/1993 | Tagawa et al. |
| 5,328,470 | A | 7/1994 | Nabel et al. |
| 5,356,633 | A | 10/1994 | Woodle et al. |
| 5,540,935 | A | 7/1996 | Miyazaki et al. |
| 5,543,152 | A | 8/1996 | Webb et al. |
| 5,556,948 | A | 9/1996 | Tagawa et al. |
| 5,665,710 | A | 9/1997 | Rahman et al. |
| 5,705,188 | A | 1/1998 | Junichi et al. |
| 6,218,108 | B1 | 4/2001 | Kool |
| 6,887,906 | B1 | 5/2005 | Teng et al. |
| 2007/0031844 | A1* | 2/2007 | Khvorova et al. ............. 435/6 |

FOREIGN PATENT DOCUMENTS

| EP | 1 394 274 A2 | 3/2004 |
| WO | WO 88/04924 A1 | 7/1988 |
| WO | WO 90/04384 A1 | 5/1990 |
| WO | WO 91/05545 A1 | 5/1991 |
| WO | WO 94/20073 A1 | 9/1994 |
| WO | WO 96/10391 A1 | 4/1996 |
| WO | WO 96/40062 A1 | 12/1996 |
| WO | WO 97/04787 A1 | 2/1997 |
| WO | WO 97/13499 A1 | 4/1997 |
| WO | WO 97/30731 A2 | 8/1997 |
| WO | WO 02/092854 A2 | 11/2002 |
| WO | WO 03/057847 A2 | 7/2003 |
| WO | WO 2004/050694 A2 | 6/2004 |
| WO | WO 2004/094636 A1 | 11/2004 |
| WO | WO 2008/043561 A2 | 4/2008 |
| WO | WO 2008/152131 A2 | 12/2008 |

OTHER PUBLICATIONS

Amosova et al., "Effect of the 1-(24-deoxy-b-D-ribofuranosyl)-3-nitropyrrole residue on the stability of DNA duplexes and triplexes", Nucleic Acids Research, 1997 vol. 25 No. 10 pp. 1930-1934.

Berger et al., "Universal bases for hybridization, replication and chain termination", Nucleic Acids Research, 2000 vol. 28 No. 15 pp. 2911-2914.

Chaudhuri et al., "Very High Affinity DNA Recognition by Bicyclic and Cross-Linked Oligonucleotides", J. Am. Chem. Soc., 1995 vol. 117 pp. 10434-10442.

Chen et al., "Gene therapy for brain tumors: Regression of experimental gliomas by adenovirus-mediated gene transfer in vivo", Proc. Natl. Acad. Sci., 1994 vol. 91 pp. 3054-3057.

Du Plessis et al., "The influence of particle size of liposomes on the deposition of drug into skin", International Journal of Pharmaceutics, 1994 vol. 103 pp. 277-282.

Guckian et al., "Experimental Measurement of Aromatic Stacking Affinities in the Context of Duplex DNA", J. Am. Chem. Soc., 1996 vol. 118 pp. 8182-8183.

Guckian et al., "Structure and Base Pairing Properties of a Replicable Nonpolar Isostere for Deoxyadenosine", J. Org. Chem., 1998 vol. 63 pp. 9652-9656.

Ho et al., "Preparation of Microemulsions Using Polyglycerol Fatty Acid Esters as Surfactant for the Delivery of Protein Drugs", Journal of Pharmaceutical Sciences, 1996 vol. 85 No. 2 pp. 138-143.

Loakes et al., "Stability and Structure of DNA Oligonucleotides Containing Non-specific Base Analogues", J. Mol. Biol., 1997 vol. 270 pp. 426-435.

Loakes et al., "The applications of universal DNA base analogues", Nucleic Acids Research, 2001 vol. 29 No. 12 pp. 2437-2447.

McMinn et al., "Efforts toward Expansion of the Genetic Alphabet: DNA Polymerase Recognition of a Highly Stable, Self-Pairing Hydrophobic Base", J. Am. Chem. Soc., 1999 vol. 121 pp. 11585-11586.

Morales et al., "Minor Groove Interactions between Polymerase and DNA: More Essential to Replication than Watson-Crick Hydrogen Bonds?", J. Am. Chem. Soc., 1999 vol. 121 pp. 2323-2324.

Moran et al., "Difluorotoluene, a Nonpolar Isostere for Thymine, Codes Specifically and Efficiently for Adenine in DNA Replication", J. Am. Chem. Soc., 1997 vol. 119 pp. 2056-2057.

(Continued)

*Primary Examiner*—Sean R McGarry

(57) ABSTRACT

The invention relates to compositions and methods for modulating the expression of alpha-ENaC, and more particularly to the downregulation of alpha-ENaC expression by chemically modified oligonucleotides.

27 Claims, 2 Drawing Sheets

OTHER PUBLICATIONS

Figure 1:
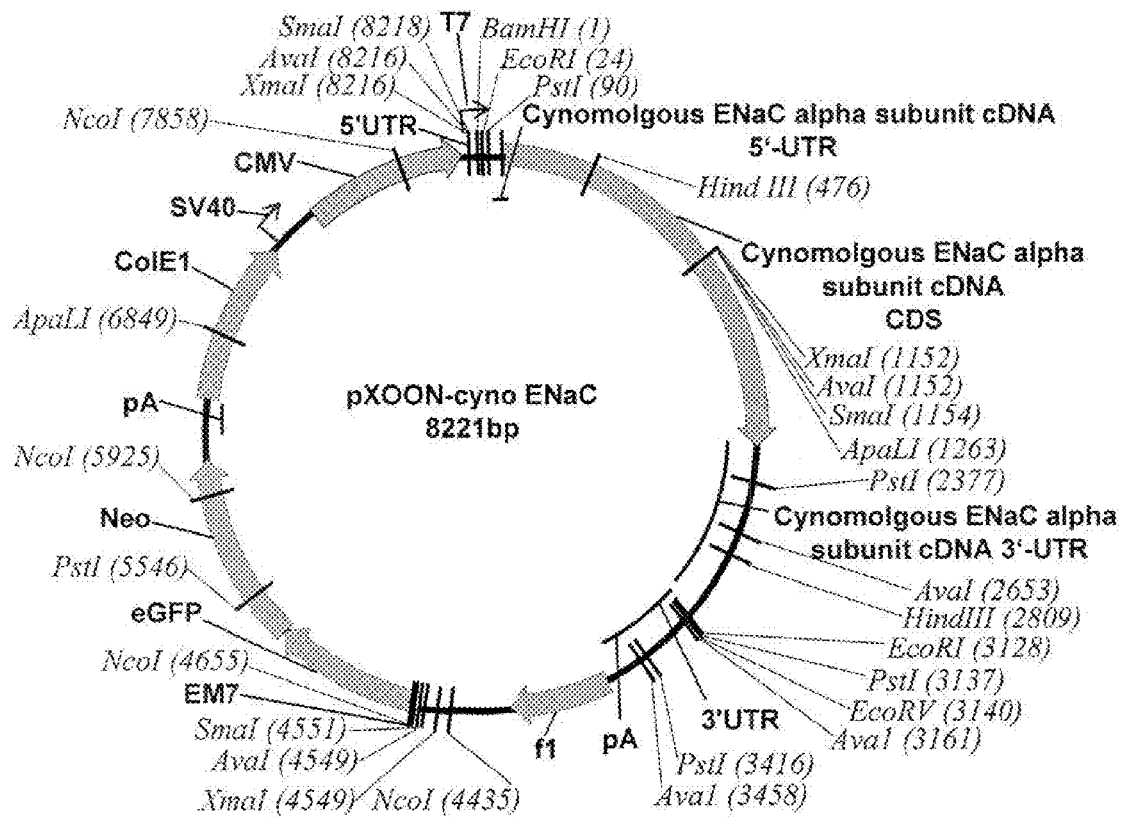

Moran et al., "A thymidine triphosphate shape analog lacking Watson-Crick pairing ability is replicated with high sequence selectivity", Proc. Natl. Acad. Sci., 1997 vol. 94 pp. 10506-10511.

Oliver et al., "Effect of the Universal Base 3-Nitropyrrole on the Selectivity of Neighboring Natural Bases", Organic Letters, 2001 vol. 3 No. 13 pp. 1977-1980.

O'Neill et al., "A Highly Effective Nonpolar Isostere of Deoxyguanosine: Synthesis, Structure, Stacking, and Base Pairing", J. Org. Chem., 2002 vol. 67 pp. 5869-5875.

Schweitzer et al., "Aromatic Nonpolar Nucleosides as Hydrophobic Isosteres of Pyrimidine and Purine Nucleosides", J. Org. Chem., 1994 vol. 59 pp. 7238-7242.

Shankar et al., "The Prospect of Silencing Disease Using RNA Interference", JAMA, 2005 vol. 293 No. 11 pp. 1367-1373.

Takakura et al., "Uptake Characteristics of Oligonucleotides in the Isolated Rat Liver Perfusion System", Antisense & Nucleic Acid Drug Development, 1996 vol. 6 pp. 177-183.

Tuschl et al., "Mechanisms of gene silencing by double-stranded RNA", Nature, 2004 vol. 431 pp. 343-349.

Vallone et al., "Melting studies of short DNA hairpins containing the universal base 5-nitroindole", Nucleic Acids Research, 1999 vol. 27 No. 17 pp. 3589-3596.

* cited by examiner

RNAI INHIBITION OF ALPHA-ENAC EXPRESSION

TECHNICAL FIELD

The invention relates to the field of ENaC-mediated airway ion transport and compositions and methods for modulating alpha-ENaC expression, and more particularly to the down-regulation of alpha-ENaC by oligonucleotides via RNA interference which are administered locally to the lungs and nasal passage via inhalation/intranasal administration, or are administered systemically, e.g. by via intravenous injection.

BACKGROUND

RNA interference or "RNAi" is a term initially coined by Fire and co-workers to describe the observation that double-stranded RNA (dsRNA) can block gene expression when it is introduced into worms (Fire et al., Nature 391:806-811, 1998). Short dsRNA directs gene-specific, post-transcriptional silencing in many organisms, including vertebrates, and has provided a new tool for studying gene function. This technology has been reviewed numerous times recently, see, for example Novina, C. D., and Sharp, P., Nature 2004, 430: 161, and Sandy, P., et al., Biotechniques 2005, 39:215, hereby incorporated by reference.

The mucosal surfaces at the interface between the environment and the body have evolved a number of protective mechanisms. A principal form of such innate defense is to cleanse these surfaces with liquid. Typically, the quantity of the liquid layer on a mucosal surface reflects the balance between epithelial liquid secretion, often reflecting anion ($Cl^-$ and or $HCO_3^-$) secretion coupled with water (and a cation counter-ion), and epithelial liquid absorption, often reflecting $Na^+$ absorption, coupled with water and counter anion ($Cl^-$ and or $HCO_3^-$). Many diseases of mucosal surfaces are caused by too little protective liquid on those mucosal surfaces created by an imbalance between secretion (too little) and absorption (relatively too much). The defective salt transport processes that characterize these mucosal dysfunctions reside in the epithelial layer of the mucosal surface. One approach to replenish the protective liquid layer on mucosal surfaces is to "re-balance" the system by blocking $Na^+$ channel mediated liquid absorption. The epithelial protein that mediates the rate-limiting step of $Na^+$ and liquid absorption is the epithelial $Na^+$ channel (ENaC). Alpha-ENaC is positioned on the apical surface of the epithelium, i.e. the mucosal surface-environmental interface. Inhibition of alpha-ENaC mediated $Na^+$ mediated liquid absorption may achieve therapeutic utility. Therefore, there is a need for the development of effective therapies for the treatment and prevention of diseases or disorders in which alpha-ENaC is implicated, e.g. cystic fibrosis in humans and animals, and particularly for therapies with high efficiency. One prerequisite for high efficiency is that the active ingredient is not degraded too quickly in a physiological environment.

SUMMARY

The present invention provides specific compositions and methods that are useful in reducing alpha-ENaC levels in a subject, e.g., a mammal, such as a human, e.g. by inhaled, intranasal or intratracheal administration of such agents.

The present invention specifically provides iRNA agents consisting of, consisting essentially of or comprising at least 15 or more contiguous nucleotides for alpha-ENaC, and more particularly agents comprising 15 or more contiguous nucleotides from one of the sequences provided in Tables 1A-1D. The iRNA agent preferably comprises less than 30 nucleotides per strand, e.g., 21-23 nucleotides, such as those provided in Tables 1A-1D. The double stranded iRNA agent can either have blunt ends or more preferably have overhangs of 1-4 nucleotides from one or both 3' ends of the agent.

Further, the iRNA agent can either contain only naturally occurring ribonucleotide subunits, or can be synthesized so as to contain one or more modifications to the sugar, phosphate or base of one or more of the ribonucleotide subunits that is included in the agent. The iRNA agent can be further modified so as to be attached to a ligand that is selected to improve stability, distribution or cellular uptake of the agent, e.g. cholesterol. The iRNA agents can further be in isolated form or can be part of a pharmaceutical composition used for the methods described herein, particularly as a pharmaceutical composition formulated for delivery to the lungs or nasal passage or formulated for parental administration. The pharmaceutical compositions can contain one or more iRNA agents, and in some embodiments, will contain two or more iRNA agents, each one directed to a different segment the alpha-ENaC gene.

One aspect of the present invention relates to a double-stranded oligonucleotide comprising at least one non-natural nucleobase. In certain embodiments, the non-natural nucleobase is difluorotolyl, nitroindolyl, nitropyrrolyl, or nitroimidazolyl. In a preferred embodiment, the non-natural nucleobase is difluorotolyl. In certain embodiments, only one of the two oligonucleotide strands comprising the double-stranded oligonucleotide contains a non-natural nucleobase. In certain embodiments, both of the oligonucleotide strands comprising the double-stranded oligonucleotide independently contain a non-natural nucleobase.

The present invention further provides methods for reducing the level of alpha-ENaC mRNA in a cell. Such methods comprise the step of administering one of the iRNA agents of the present invention to a subject as further described below. The present methods utilize the cellular mechanisms involved in RNA interference to selectively degrade the target RNA in a cell and are comprised of the step of contacting a cell with one of the iRNA agents of the present invention. Such methods can be performed directly on a cell or can be performed on a mammalian subject by administering to a subject one of the iRNA agents/pharmaceutical compositions of the present invention. Reduction of target RNA in a cell results in a reduction in the amount of encoded protein produced, and in an organism, results in reduction of epithelial potential difference, decreased fluid absorption and increased mucociliary clearance.

The methods and compositions of the invention, e.g., the methods and iRNA agent compositions can be used with any dosage and or formulation described herein, as well as with any route of administration described herein.

The details of one or more embodiments of the invention are set forth in the accompanying drawings and the description below. Other features, objects, and advantages of the invention will be apparent from this description, the drawings, and from the claims. This application incorporates all cited references, patents, and patent applications by references in their entirety for all purposes.

In the Figures:

FIG. 1: Restriction digest map of pXoon construct for cloned cynomolgous α-EnaC.

Figure 2:
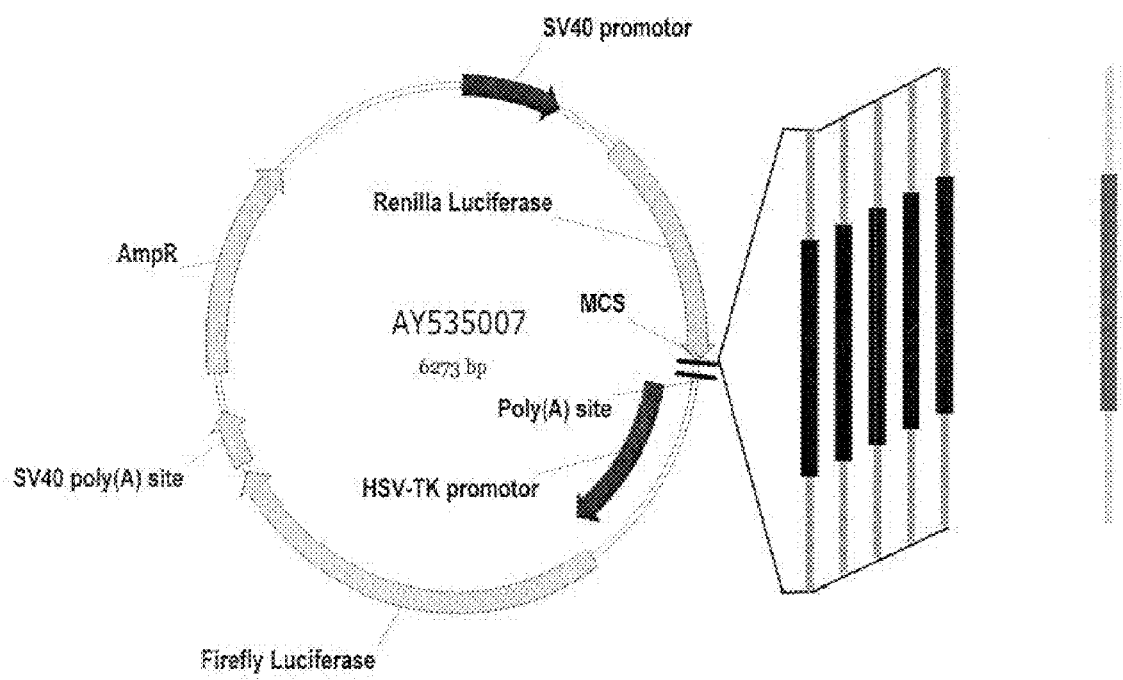

FIG. 2: Cloning of the predicted off-target and the on-target recognition sites into the AY535007 dual luciferase reporter construct. Fragments consist of 19 nt of the predicted target site and 10 nt of flanking sequence at both the 5' and 3' ends.

DETAILED DESCRIPTION OF CERTAIN PREFERRED EMBODIMENTS OF THE INVENTION

For ease of exposition the term "nucleotide" or "ribonucleotide" is sometimes used herein in reference to one or more monomeric subunits of an RNA agent. It will be understood that the usage of the term "ribonucleotide" or "nucleotide" herein can, in the case of a modified RNA or nucleotide surrogate, also refer to a modified nucleotide, or surrogate replacement moiety, as further described below, at one or more positions.

An "RNA agent" as used herein, is an unmodified RNA, modified RNA, or nucleoside surrogate, each of which is described herein or is well known in the RNA synthetic art. While numerous modified RNAs and nucleoside surrogates are described, preferred examples include those which have greater resistance to nuclease degradation than do unmodified RNAs. Preferred examples include those that have a 2' sugar modification, a modification in a single strand overhang, preferably a 3' single strand overhang, or, particularly if single stranded, a 5'-modification which includes one or more phosphate groups or one or more analogs of a phosphate group.

An "iRNA agent" (abbreviation for "interfering RNA agent") as used herein, is an RNA agent, which can down-regulate the expression of a target gene, e.g. ENaC gene SCNN1A. While not wishing to be bound by theory, an iRNA agent may act by one or more of a number of mechanisms, including post-transcriptional cleavage of a target mRNA sometimes referred to in the art as RNAi, or pre-transcriptional or pre-translational mechanisms.

A "ds iRNA agent" (abbreviation for "double stranded iRNA agent"), as used herein, is an iRNA agent which includes more than one, and preferably two, strands in which interstrand hybridization can form a region of duplex structure. A "strand" herein refers to a contigouous sequence of nucleotides (including non-naturally occurring or modified nucleotides). The two or more strands may be, or each form a part of, separate molecules, or they may be covalently interconnected, e.g., by a linker, e.g., a polyethyleneglycol linker, to form one molecule. At least one strand can include a region which is sufficiently complementary to a target RNA. Such strand is termed the "antisense strand." A second strand of the dsRNA agent, which comprises a region complementary to the antisense strand, is termed the "sense strand." However, a ds iRNA agent can also be formed from a single RNA molecule which is at least partly self-complementary, forming, e.g., a hairpin or panhandle structure, including a duplex region. The latter are herein referred to as short hairpin RNAs or shRNAs. In such case, the term "strand" refers to one of the regions of the RNA molecule that is complementary to another region of the same RNA molecule.

Although, in mammalian cells, long ds iRNA agents can induce the interferon response which is frequently deleterious, short ds iRNA agents do not trigger the interferon response, at least not to an extent that is deleterious to the cell and or host (Manche et al., *Mol. Cell. Biol.* 12:5238, 1992; Lee et al., *Virology* 199:491, 1994; Castelli et al., *J. Exp. Med.* 186:967, 1997; Zheng et al., *RNA* 10:1934, 2004; Heidel et al., *Nature Biotechnol.* 22 1579). The iRNA agents of the present invention include molecules which are sufficiently short that they do not trigger a deleterious non-specific interferon response in normal mammalian cells. Thus, the administration of a composition including an iRNA agent (e.g., formulated as described herein) to a subject can be used to decrease expression of alpha-ENaC in the subject, while circumventing an interferon response. Molecules that are short enough that they do not trigger a deleterious interferon response are termed siRNA agents or siRNAs herein. "siRNA agent" or "siRNA" as used herein, refers to an iRNA agent, e.g., a ds iRNA agent, that is sufficiently short that it does not induce a deleterious interferon response in a mammalian, and particularly a human, cell, e.g., it has a duplexed region of less than 60 but preferably less than 50, 40, or 30 nucleotide pairs.

The isolated iRNA agents described herein, including ds iRNA agents and siRNA agents, can mediate the decreased expression of alpha-ENaC, e.g., by RNA degradation. For convenience, such RNA is also referred to herein as the RNA to be silenced. Such a nucleic acid is also referred to as a "target RNA", sometimes "target RNA molecule" or sometimes "target gene".

As used herein, the phrase "mediates RNAi" refers to the ability of an agent to silence, in a sequence-specific manner, a target gene. "Silencing a target gene" means the process whereby a cell containing and or expressing a certain product of the target gene when not in contact with the agent, will contain and or express at least 10%, 20%, 30%, 40%, 50%, 60%, 70%, 80%, or 90% less of such gene product when contacted with the agent, as compared to a similar cell which has not been contacted with the agent. Such product of the target gene can, for example, be a messenger RNA (mRNA), a protein, or a regulatory element.

As used herein, the term "complementary" is used to indicate a sufficient degree of complementarity such that stable and specific binding occurs between a compound of the invention and a target RNA molecule, e.g., alpha-ENaC mRNA. Specific binding requires a sufficient degree of complementarity to avoid non-specific binding of the oligomeric compound to non-target sequences under conditions in which specific binding is desired, i.e., under physiological conditions in the case of in vivo assays or therapeutic treatment, or in the case of in vitro assays, under conditions in which the assays are performed. The non-target sequences typically differ from the target sequences by at least 2, 3 or 4 nucleotides.

As used herein, an iRNA agent is "sufficiently complementary" to a target RNA, e.g., a target mRNA (e.g., alpha-ENaC mRNA) if the iRNA agent reduces the production of a protein encoded by the target RNA in a cell. The iRNA agent may also be "exactly complementary" to the target RNA, e.g., the target RNA and the iRNA agent anneal, preferably to form a hybrid made exclusively of Watson-Crick basepairs in the region of exact complementarity. A "sufficiently complementary" iRNA agent can include an internal region (e.g., of at least 10 nucleotides) that is exactly complementary to a target alpha-ENaC RNA. Moreover, in some embodiments, the iRNA agent specifically discriminates a single-nucleotide difference. In this case, the iRNA agent only mediates RNAi if exact complementarity is found in the region (e.g., within 7 nucleotides of) the single-nucleotide difference. Preferred iRNA agents will be based on or consist of or comprise the sense and antisense sequences provided in Tables 1A-1D.

As used herein, "essentially identical" when used referring to a first nucleotide sequence in comparison to a second nucleotide sequence means that the first nucleotide sequence is identical to the second nucleotide sequence except for up to one, two or three nucleotide substitutions (e.g., adenosine replaced by uracil). "Essentially retaining the ability to inhibit alpha-ENaC expression in cultured human cells," as used herein referring to an iRNA agent not identical to but derived from one of the iRNA agents of Tables 1A-1D by deletion, addition or substitution of nucleotides, means that the derived iRNA agent possesses an inhibitory activity not less than 20% of the inhibitory activity of the iRNA agent of Tables 1A-1D from which it was derived. For example, an iRNA agent derived from an iRNA agent of Tables 1A-1D which lowers the amount of alpha-ENaC mRNA present in cultured human cells by 70% may itself lower the amount of mRNA present in cultured human cells by at least 50% in order to be considered as essentially retaining the ability to inhibit alpha-ENaC replication in cultured human cells. Optionally, an iRNA agent of the invention may lower the amount of alpha-ENaC mRNA present in cultured human cells by at least 50%.

As used herein, a "subject" refers to a mammalian organism undergoing treatment for a disorder mediated by alpha-ENaC. The subject can be any mammal, such as a cow, horse, mouse, rat, dog, pig, goat, or a primate. In the preferred embodiment, the subject is a human.

Design and Selection of iRNA Agents

As used herein, "disorders associated with alpha-ENaC expression" refers to any biological or pathological state that (1) is mediated at least in part by the presence of alpha-ENaC and (2) whose outcome can be affected by reducing the level of the alpha-ENaC present. Specific disorders associated with alpha-ENaC expression are noted below.

The present invention is based on the design, synthesis and generation of iRNA agents that target alpha-ENaC and the demonstration of silencing of the alpha-ENaC gene in vitro in cultured cells after incubation with an iRNA agent, and the resulting protective effect towards alpha-ENaC mediated disorders.

An iRNA agent can be rationally designed based on sequence information and desired characteristics. For example, an iRNA agent can be designed according to the relative melting temperature of the candidate duplex. Generally, the duplex should have a lower melting temperature at the 5' end of the antisense strand than at the 3' end of the antisense strand.

The present invention provides compositions containing siRNA(s) and or shRNA(s) targeted to one or more alpha-ENaC transcripts.

For any particular gene target that is selected, the design of siRNAs or shRNAs for use in accordance with the present invention will preferably follow certain guidelines. Also, in many cases, the agent that is delivered to a cell according to the present invention may undergo one or more processing steps before becoming an active suppressing agent (see below for further discussion); in such cases, those of ordinary skill in the art will appreciate that the relevant agent will preferably be designed to include sequences that may be necessary for its processing.

Diseases mediated by dysfunction of the epithelial sodium channel, include diseases associated with the regulation of fluid volumes across epithelial membranes. For example, the volume of airway surface liquid is a key regulator of mucociliary clearance and the maintenance of lung health. The blockade of the epithelial sodium channel will promote fluid accumulation on the mucosal side of the airway epithelium thereby promoting mucus clearance and preventing the accumulation of mucus and sputum in respiratory tissues (including lung airways). Such diseases include respiratory diseases, such as cystic fibrosis, primary ciliary dyskinesia, chronic bronchitis, chronic obstructive pulmonary disease (COPD), asthma, respiratory tract infections (acute and chronic; viral and bacterial) and lung carcinoma. Diseases mediated by blockade of the epithelial sodium channel also include diseases other than respiratory diseases that are associated with abnormal fluid regulation across an epithelium, perhaps involving abnormal physiology of the protective surface liquids on their surface, e.g., xerostomia (cry mouth) or keratoconjunctivitis sire (dry eye). Furthermore, blockade of the epithelial sodium channel in the kidney could be used to promote diuresis and thereby induce a hypotensive effect.

Treatment in accordance with the invention may be symptomatic or prophylactic.

Asthma includes both intrinsic (non-allergic) asthma and extrinsic (allergic) asthma, mild asthma, moderate asthma, severe asthma, bronchitic asthma, exercise-induced asthma, occupational asthma and asthma induced following bacterial infection. Treatment of asthma is also to be understood as embracing treatment of subjects, e.g., of less than 4 or 5 years of age, exhibiting wheezing symptoms and diagnosed or diagnosable as "wheezy infants", an established patient category of major medical concern and now often identified as incipient or early-phase asthmatics. (For convenience this particular asthmatic condition is referred to as "wheezy-infant syndrome".)

Prophylactic efficacy in the treatment of asthma will be evidenced by reduced frequency or severity of symptomatic attack, e.g., of acute asthmatic or bronchoconstrictor attack, improvement in lung function or improved airways hyperreactivity. It may further be evidenced by reduced requirement for other, symptomatic therapy, i.e., therapy for or intended to restrict or abort symptomatic attack when it occurs, e.g., anti-inflammatory (e.g., corticosteroid) or bronchodilatory. Prophylactic benefit in asthma may, in particular, be apparent in subjects prone to "morning dipping". "Morning dipping" is a recognized asthmatic syndrome, common to a substantial percentage of asthmatics and characterized by asthma attack, e.g., between the hours of about 4-6 am, i.e., at a time normally substantially distant from any previously administered symptomatic asthma therapy.

Chronic obstructive pulmonary disease includes chronic bronchitis or dyspnea associated therewith, emphysema, as well as exacerbation of airways hyperreactivity consequent to other drug therapy, in particular, other inhaled drug therapy. The invention is also applicable to the treatment of bronchitis of whatever type or genesis including, e.g., acute, arachidic, catarrhal, croupus, chronic or phthinoid bronchitis.

Based on the results shown herein, the present invention provides iRNA agents that reduce alpha-ENaC expression in cultured cells and in a subject, e.g. a mammalian, for example a human. Tables 1A-1D provide exemplary iRNA agents targeting alpha-ENaC, based on the standard nomenclature abbreviations given in Table A.

Table 1A, Seq Id No.s 305-608, Table 1B and Table 1D, Seq Id No.s 1519-1644 list siRNAs that do not comprise nucleotide modifications except for one phosphorothioate linkage between the 3'-terminal and the penultimate thymidines. The remaining Seq Ids in Tables 1A-1D lists siRNAs wherein all nucleotides comprising pyrimidine bases are 2'-O-methyl-modified nucleotides in the sense strand, and all uridines in a sequence context of 5'-ua-3' as well as all cytidines in a sequence context of or 5'-ca-3' are 2'-O-methyl-modified nucleotides in the antisense strand.

Based on these results, the invention specifically provides an iRNA agent that includes a sense strand having at least 15 contiguous nucleotides of the sense strand sequences of the agents provided in Tables 1A-1D, and an antisense strand having at least 15 contiguous nucleotides of the antisense sequences of the agents provided in Tables 1A-1D.

The iRNA agents shown in Tables 1A-1D are composed of two strands of 19 nucleotides in length which are complementary or identical to the target sequence, plus a 3'-T$\underline{T}$ overhang. The present invention provides agents that comprise at least 15, or at least 16, 17, or 18, or 19 contiguous nucleotides from these sequences. However, while these lengths may potentially be optimal, the iRNA agents are not meant to be limited to these lengths. The skilled person is well aware that shorter or longer iRNA agents may be similarly effective, since, within certain length ranges, the efficacy is rather a function of the nucleotide sequence than strand length. For example, Yang, et al., *PNAS* 99:9942-9947 (2002), demonstrated similar efficacies for iRNA agents of lengths between 21 and 30 base pairs. Others have shown effective silencing of genes by iRNA agents down to a length of approx. 15 base pairs (Byrom, et al., "Inducing RNAi with siRNA Cocktails Generated by RNase III" *Tech Notes* 10(1), Ambion, Inc., Austin, Tex.).

Therefore, it is possible and contemplated by the instant invention to select from the sequences provided in Tables 1A-1D a partial sequence of between 15 to 19 nucleotides for the generation of an iRNA agent derived from one of the sequences provided in Tables 1A-1D. Alternatively, one may add one or several nucleotides to one of the sequences provided in Tables 1A-1D, or an agent comprising 15 contiguous nucleotides from one of these agents, preferably, but not necessarily, in such a fashion that the added nucleotides are complementary to the respective sequence of the target gene, e.g., alpha-ENaC. For example, the first 15 nucleotides from one of the agents can be combined with the 8 nucleotides found 5' to these sequence in alpha-ENaC mRNA to obtain an agent with 23 nucleotides in the sense and antisense strands. All such derived iRNA agents are included in the iRNA agents of the present invention, provided they essentially retain the ability to inhibit alpha-ENaC replication in cultured human cells.

The antisense strand of an iRNA agent should be equal to or at least, 14, 15, 16, 17, 18, 19, 25, 29, 40, or 50 nucleotides in length. It should be equal to or less than 60, 50, 40, or 30, nucleotides in length. Preferred ranges are 15-30, 17 to 25, 19 to 23, and 19 to 21 nucleotides in length.

The sense strand of an iRNA agent should be equal to or at least 14, 15, 16 17, 18, 19, 25, 29, 40, or 50 nucleotides in length. It should be equal to or less than 60, 50, 40, or 30 nucleotides in length. Preferred ranges are 15-30, 17 to 25, 19 to 23, and 19 to 21 nucleotides in length.

The double stranded portion of an iRNA agent should be equal to or at least, 15, 16 17, 18, 19, 20, 21, 22, 23, 24, 25, 29, 40, or 50 nucleotide pairs in length. It should be equal to or less than 60, 50, 40, or 30 nucleotides pairs in length. Preferred ranges are 15-30, 17 to 25, 19 to 23, and 19 to 21 nucleotides pairs in length.

Generally, the iRNA agents of the instant invention include a region of sufficient complementarity to the alpha-ENaC mRNA, and are of sufficient length in terms of nucleotides, that the iRNA agent, or a fragment thereof, can mediate down regulation of the alpha-ENaC gene. It is not necessary that there be perfect complementarity between the iRNA agent and the target gene, but the correspondence must be sufficient to enable the iRNA agent, or a cleavage product thereof, to direct sequence specific silencing, e.g., by RNAi cleavage of an alpha-ENaC mRNA.

Therefore, the iRNA agents of the instant invention include agents comprising a sense strand and antisense strand each comprising a sequence of at least 16, 17 or 18 nucleotides which is essentially identical, as defined below, to one of the sequences of Tables 1A-1D, except that not more than 1, 2 or 3 nucleotides per strand, respectively, have been substituted by other nucleotides (e.g. adenosine replaced by uracil), while essentially retaining the ability to inhibit alpha-ENaC expression in cultured human cells. These agents will therefore possess at least 15 nucleotides identical to one of the sequences of Tables 1A-1D, but 1, 2 or 3 base mismatches with respect to either the target alpha-ENaC sequence or between the sense and antisense strand are introduced. Mismatches to the target alpha-ENaC RNA sequence, particularly in the antisense strand, are most tolerated in the terminal regions and if present are preferably in a terminal region or regions, e.g., within 6, 5, 4, or 3 nucleotides of a 5' and or 3' terminus, most preferably within 6, 5, 4, or 3 nucleotides of the 5'-terminus of the sense strand or the 3'-terminus of the antisense strand. The sense strand need only be sufficiently complementary with the antisense strand to maintain the overall double stranded character of the molecule.

It is preferred that the sense and antisense strands be chosen such that the iRNA agent includes a single strand or unpaired region at one or both ends of the molecule. Thus, an iRNA agent contains sense and antisense strands, preferably paired to contain an overhang, e.g., one or two 5' or 3' overhangs but preferably a 3' overhang of 2-3 nucleotides. Most embodiments will have a 3' overhang. Preferred siRNA agents will have single-stranded overhangs, preferably 3' overhangs, of 1 to 4, or preferably 2 or 3 nucleotides, in length, at one or both ends of the iRNA agent. The overhangs can be the result of one strand being longer than the other, or the result of two strands of the same length being staggered. The unpaired nucleotides forming the overhang can be ribonucleotides, or they can be deoxyribonucleotides, preferably thymidine. 5'-ends are preferably phosphorylated, or they may be unphosphorylated.

Preferred lengths for the duplexed region are between 15 and 30, most preferably 18, 19, 20, 21, 22, and 23 nucleotides in length, e.g., in the siRNA agent range discussed above. siRNA agents can resemble in length and structure the natural Dicer processed products from long dsRNAs. Embodiments in which the two strands of the siRNA agent are linked, e.g., covalently linked, are also included. Hairpin, or other single strand structures which provide the required double stranded region, and preferably a 3' overhang are also within the invention.

Evaluation of Candidate iRNA Agents

As noted above, the present invention provides a system for identifying siRNAs that are useful as inhibitors of alpha-ENaC. Since, as noted above, shRNAs are processed intracellularly to produce siRNAs having duplex portions with the same sequence as the stem structure of the shRNA, the system is equally useful for identifying shRNAs that are useful as inhibitors of alpha-ENaC. For purposes of description this section will refer to siRNAs, but the system also encompasses corresponding shRNAs. Specifically, the present invention demonstrates the successful preparation of siRNAs targeted to inhibit alpha-ENaC activity. The techniques and reagents described herein can readily be applied to design potential new siRNAs, targeted to other genes or gene regions, and tested for their activity in inhibiting alpha-ENaC as discussed herein.

In various embodiments of the invention potential alpha-ENaC inhibitors can be tested for suppression of endogenous alpha-ENaC expression by introducing candidate siRNA(s) into cells (e.g., by exogenous administration or by introducing a vector or construct that directs endogenous synthesis of siRNA into the cell), or in laboratory animals by pulmonary or nasal administration. Alternately, potential alpha-ENaC inhibitors can be tested in vitro by transient co-transfection of candidate siRNA(s) together with an alpha-ENaC-expression plasmid. The ability of the candidate siRNA(s) to reduce target transcript levels and or to inhibit or suppress one or more aspects or features of alpha-ENaC activity such as epithelial potential difference or airway surface fluid absorption is then assessed.

Cells or laboratory animals to which inventive siRNA compositions have been delivered (test cells/animals) may be compared with similar or comparable cells or laboratory animals that have not received the inventive composition (control cells/animals, e.g., cells/animals that have received either no siRNA or a control siRNA such as an siRNA targeted to a non-endogenous transcript such as green fluorescent protein (GFP)). The ion transport phenotype of the test cells/animals can be compared with the phenotype of control cells/animals, providing that the inventive siRNA share sequence cross-reactivity with the test cell type/species. Production of alpha-ENaC protein and short circuit current (in vitro or ex vivo) may be compared in the test cells/animals relative to the control cells/animals. Other indicia of alpha-ENaC activity, including ex vivo epithelial potential difference or in vivo mucocilliary clearance or whole body magnetic resonance imaging (MRI), can be similarly compared. Generally, test cells/animals and control cells/animals would be from the same species and, for cells, of similar or identical cell type. For example, cells from the same cell line could be compared. When the test cell is a primary cell, typically the control cell would also be a primary cell.

For example, the ability of a candidate siRNA to inhibit alpha-ENaC activity may conveniently be determined by (i) delivering the candidate siRNA to cells (ii) assessing the expression levels of alpha-ENaC mRNA relative to an endogenously expressed control gene (iii) comparing the amiloride-sensitive current in an in vitro cell model produced in the presence of the siRNA with the amount produced in the absence of the siRNA. This latter assay may be used to test siRNAs that target any target transcript that may influence alpha-ENaC activity indirectly and is not limited to siRNAs that target the transcripts that encode the ENaC channel subunits.

The ability of a candidate siRNA to reduce the level of the target transcript may be assessed by measuring the amount of the target transcript using, for example, Northern blots, nuclease protection assays, probe hybridization, reverse transcription (RT)-PCR, real-time RT-PCR, microarray analysis, etc. The ability of a candidate siRNA to inhibit production of a polypeptide encoded by the target transcript (either at the transcriptional or post-transcriptional level) may be measured using a variety of antibody-based approaches including, but not limited to, Western blots, immunoassays, ELISA, flow cytometry, protein microarrays, etc. In general, any method of measuring the amount of either the target transcript or a polypeptide encoded by the target transcript may be used.

In general, certain preferred alpha-ENaC iRNA inhibitors reduce the target transcript level at least about 2 fold, preferably at least about 4 fold, more preferably at least about 8 fold, at least about 16 fold, at least about 64 fold or to an even greater degree relative to the level that would be present in the absence of the inhibitor (e.g., in a comparable control cell lacking the inhibitor). In general, certain preferred alpha-ENaC iRNA inhibitors inhibit ENaC channel activity, so that the activity is lower in a cell containing the inhibitor than in a control cell not containing the inhibitor by at least about 2 fold, preferably at least about 4 fold, more preferably at least about 8 fold, at least about 16 fold, at least about 64 fold, at least about 100 fold, at least about 200 fold, or to an even greater degree.

Certain preferred alpha-ENaC iRNA inhibitors inhibit ENaC channel activity for at least 12 hours, at least 24 hours, at least 36 hours, at least 48 hours, at least 60 hours, at least 72 hours, at least 96 hours, at least 120 hours, at least 144 hours or at least 168 hours following administration of the siRNA and infection of the cells. Certain preferred alpha-ENaC inhibitors prevent (i.e., reduce to undetectable levels) or significantly reduce alpha-ENaC activity for at least 24 hours, at least 36 hours, at least 48 hours, or at least 60 hours following administration of the siRNA. According to various embodiments of the invention a significant reduction in alpha-ENaC activity is a reduction to less than approximately 90% of the level that would occur in the absence of the siRNA, a reduction to less than approximately 75% of the level that would occur in the absence of the siRNA, a reduction to less than approximately 50% of the level that would occur in the absence of the siRNA, a reduction to less than approximately 25% of the level that would occur in the absence of the siRNA, or a reduction to less than approximately 10% of the level that would occur in the absence of the siRNA. Reduction in alpha-ENaC activity may be measured using any suitable method including, but not limited to, short circuit current measurement of amiloride sensitivity in vitro, epithelial potential difference ex vivo or in vivo mucocilliary clearance or whole body/lung MRI.

Stability Testing, Modification, and Retesting of iRNA Agents

A candidate iRNA agent can be evaluated with respect to stability, e.g., its susceptibility to cleavage by an endonuclease or exonuclease, such as when the iRNA agent is introduced into the body of a subject. Methods can be employed to identify sites that are susceptible to modification, particularly cleavage, e.g., cleavage by a component found in the body of a subject. Such methods may include the isolation and identification of most abundant fragments formed by degradation of the candidate iRNA agent after its incubation with isolated biological media in vitro, e.g. serum, plasma, sputum, cerebrospinal fluid, or cell or tissue homogenates, or after contacting a subject with the candidate iRNA agent in vivo, thereby identifying sites prone to cleavage. Such methods are, for example, without limitation, in International Patent Application Publication No. WO2005115481, filed on May 27, 2005.

When sites susceptible to cleavage are identified, a further iRNA agent can be designed and or synthesized wherein the potential cleavage site is made resistant to cleavage, e.g. by introduction of a 2'-modification on the site of cleavage, e.g. a 2'-O-methyl group. This further iRNA agent can be retested for stability, and this process may be iterated until an iRNA agent is found exhibiting the desired stability.

In Vivo Testing

An iRNA agent identified as being capable of inhibiting alpha-ENaC gene expression can be tested for functionality in vivo in an animal model (e.g., in a mammal, such as in mouse, rat, guinea-pig or primate). For example, the iRNA agent can be administered to an animal, and the iRNA agent evaluated with respect to its biodistribution, stability, and its ability to inhibit alpha-ENaC expression or modulate a biological or pathological process mediated at least in part by alpha-ENaC.

The iRNA agent can be administered directly to the target tissue, such as by injection, or the iRNA agent can be administered to the animal model in the same manner that it would be administered to a human. Preferably, the iRNA agent is delivered to the subject's airways, such as by intranasal, inhaled or intratracheal administration.

The iRNA agent can also be evaluated for its intracellular distribution. The evaluation can include determining whether the iRNA agent was taken up into the cell. The evaluation can also include determining the stability (e.g., the half-life) of the iRNA agent. Evaluation of an iRNA agent in vivo can be facilitated by use of an iRNA agent conjugated to a traceable marker (e.g., a fluorescent marker such as fluorescein; a radioactive label, such as $^{35}$S, $^{32}$P, $^{33}$P, or $^{3}$H; gold particles; or antigen particles for immunohistochemistry).

The iRNA agent can be evaluated with respect to its ability to down regulate alpha-alpha-ENaC expression. Levels of alpha-ENaC gene expression in vivo can be measured, for example, by in situ hybridization, or by the isolation of RNA from tissue prior to and following exposure to the iRNA agent. Where the animal needs to be sacrificed in order to harvest the tissue, an untreated control animal will serve for comparison. alpha-ENaC RNA can be detected by any desired method, including but not limited to RT-PCR, northern blot, branched-DNA assay, or RNAase protection assay. Alternatively, or additionally, alpha-ENaC gene expression can be monitored by performing western blot analysis or immunostaining on tissue extracts treated with the iRNA agent.

Potential alpha-ENaC inhibitors can be tested using any variety of animal models that have been developed. Compositions comprising candidate siRNA(s), constructs or vectors capable of directing synthesis of such siRNAs within a host cell, or cells engineered or manipulated to contain candidate siRNAs may be administered to an animal. The ability of the composition to suppress alpha-ENaC expression and or to modify ENaC-dependent phenotypes and/or lessen their severity relative to animals that have not received the potential alpha-ENaC inhibitor is assessed. Such models include, but are not limited to, murine, rat, guinea pig, sheep and non-human primate models for ENaC-dependent phenotypes, all of which are known in the art and are used for testing the efficacy of potential alpha-ENaC therapeutics.

Utilising the systems invented for identifying candidate therapeutic siRNA agents, suitable therapeutic agents are selected from Duplex identifiers ND-8302, ND-8332, ND-8348, ND-8356, ND-8357, ND-8373, ND-8381, ND-8396, ND-8450 and ND-8453, more suitably selected from ND-8356, ND-8357 and ND-8396.

iRNA Chemistry

Described herein are isolated iRNA agents, e.g., ds RNA agents that mediate RNAi to inhibit expression of the alpha-ENaC gene.

RNA agents discussed herein include otherwise unmodified RNA as well as RNA which has been modified, e.g., to improve efficacy, and polymers of nucleoside surrogates. Unmodified RNA refers to a molecule in which the components of the nucleic acid, namely sugars, bases, and phosphate moieties, are the same or essentially the same as that which occur in nature, preferably as occur naturally in the human body. The art has referred to rare or unusual, but naturally occurring, RNAs as modified RNAs, see, e.g., Limbach et al. *Nucleic Acids Res.* 22: 2183-2196, 1994. Such rare or unusual RNAs, often termed modified RNAs (apparently because they are typically the result of a post-transcriptional modification) are within the term unmodified RNA, as used herein. Modified RNA as used herein refers to a molecule in which one or more of the components of the nucleic acid, namely sugars, bases, and phosphate moieties, are different from that which occurs in nature, preferably different from that which occurs in the human body. While they are referred to as modified "RNAs," they will of course, because of the modification, include molecules which are not RNAs. Nucleoside surrogates are molecules in which the ribophosphate backbone is replaced with a non-ribophosphate construct that allows the bases to the presented in the correct spatial relationship such that hybridization is substantially similar to what is seen with a ribophosphate backbone, e.g., non-charged mimics of the ribophosphate backbone. Examples of the above are discussed herein.

Modifications described herein can be incorporated into any double-stranded RNA and RNA-like molecule described herein, e.g., an iRNA agent. It may be desirable to modify one or both of the antisense and sense strands of an iRNA agent. As nucleic acids are polymers of subunits or monomers, many of the modifications described below occur at a position which is repeated within a nucleic acid, e.g., a modification of a base, or a phosphate moiety, or the non-linking oxygen of a phosphate moiety. In some cases the modification will occur at all of the subject positions in the nucleic acid but in many, and in fact in most, cases it will not. By way of example, a modification may only occur at a 3' or 5' terminal position, may only occur in a terminal region, e.g. at a position on a terminal nucleotide or in the last 2, 3, 4, 5, or 10 nucleotides of a strand. A modification may occur in a double strand region, a single strand region, or in both. E.g., a phosphorothioate modification at a non-linking O position may only occur at one or both termini, may only occur in a terminal regions, e.g., at a position on a terminal nucleotide or in the last 2, 3, 4, 5, or 10 nucleotides of a strand, or may occur in double strand and single strand regions, particularly at termini. Similarly, a modification may occur on the sense strand, antisense strand, or both. In some cases, the sense and antisense strand will have the same modifications or the same class of modifications, but in other cases the sense and antisense strand will have different modifications, e.g., in some cases it may be desirable to modify only one strand, e.g. the sense strand.

Two prime objectives for the introduction of modifications into iRNA agents is their stabilization towards degradation in biological environments and the improvement of pharmacological properties, e.g. pharmacodynamic properties, which are further discussed below. Other suitable modifications to a sugar, base, or backbone of an iRNA agent are described in PCT Application No. PCT/US2004/01193, filed Jan. 16, 2004. An iRNA agent can include a non-naturally occurring base, such as the bases described in PCT Application No. PCT/US2004/011822, filed Apr. 16, 2004. An iRNA agent can include a non-naturally occurring sugar, such as a non-carbohydrate cyclic carrier molecule. Exemplary features of non-naturally occurring sugars for use in iRNA agents are described in PCT Application No. PCT US2004/11829, filed Apr. 16, 2003.

An iRNA agent can include an internucleotide linkage (e.g., the chiral phosphorothioate linkage) useful for increasing nuclease resistance. In addition, or in the alternative, an iRNA agent can include a ribose mimic for increased nuclease resistance. Exemplary internucleotide linkages and ribose mimics for increased nuclease resistance are described in PCT Application No. PCT/US2004/07070, filed on Mar. 8, 2004.

An iRNA agent can include ligand-conjugated monomer subunits and monomers for oligonucleotide synthesis. Exemplary monomers are described in U.S. application Ser. No. 10/916,185, filed on Aug. 10, 2004.

An iRNA agent can have a ZXY structure, such as is described in PCT Application No. PCT/US2004/07070, filed on Mar. 8, 2004.

An iRNA agent can be complexed with an amphipathic moiety. Exemplary amphipathic moieties for use with iRNA agents are described in PCT Application No. PCT/US2004/07070, filed on Mar. 8, 2004.

In another embodiment, the iRNA agent can be complexed to a delivery agent that features a modular complex. The complex can include a carrier agent linked to one or more of (preferably two or more, more preferably all three of): (a) a condensing agent (e.g., an agent capable of attracting, e.g., binding, a nucleic acid, e.g., through ionic or electrostatic interactions); (b) a fusogenic agent (e.g., an agent capable of fusing and or being transported through a cell membrane); and (c) a targeting group, e.g., a cell or tissue targeting agent, e.g., a lectin, glycoprotein, lipid or protein, e.g., an antibody, that binds to a specified cell type. iRNA agents complexed to a delivery agent are described in PCT Application No. PCT US2004/07070, filed on Mar. 8, 2004.

An iRNA agent can have non-canonical pairings, such as between the sense and antisense sequences of the iRNA duplex. Exemplary features of non-canonical iRNA agents are described in PCT Application No. PCT US2004/07070, filed on Mar. 8, 2004.

Enhanced Nuclease Resistance

An iRNA agent, e.g., an iRNA agent that targets alpha-ENaC, can have enhanced resistance to nucleases.

One way to increase resistance is to identify cleavage sites and modify such sites to inhibit cleavage, as described in U.S. Application No. 60/559,917, filed on May 4, 2004. For example, the dinucleotides 5'-ua-3',5'-ca-3', 5'-ug-3',5'-uu-3', or 5'-cc-3' can serve as cleavage sites. In certain embodiments, all the pyrimidines of an iRNA agent carry a 2'-modification in either the sense strand, the antisense strand, or both strands, and the iRNA agent therefore has enhanced resistance to endonucleases. Enhanced nuclease resistance can also be achieved by modifying the 5' nucleotide, resulting, for example, in at least one 5'-uridine-adenine-3' (5'-ua-3') dinucleotide wherein the uridine is a 2'-modified nucleotide; at least one 5'-cytidine-adenine-3' (5'-ca-3') dinucleotide, wherein the 5'-cytidine is a 2'-modified nucleotide; at least one 5'-uridine-guanine-3' (5'-ug-3') dinucleotide, wherein the 5'-uridine is a 2'-modified nucleotide; at least one 5'-uridine-uridine-3' (5'-uu-3') dinucleotide, wherein the 5'-uridine is a 2'-modified nucleotide; or at least one 5'-cytidine-cytidine-3' (5'-cc-3') dinucleotide, wherein the 5'-cytidine is a 2'-modified nucleotide, as described in International Application No. PCT US2005/018931, filed on May 27, 2005. The iRNA agent can include at least 2, at least 3, at least 4 or at least 5 of such dinucleotides. In a particularly preferred embodiment, the 5' nucleotide in all occurrences of the sequence motifs 5'-ua-3' and 5'-ca-3' in either the sense strand, the antisense strand, or both strands is a modified nucleotide. Preferably, the 5' nucleotide in all occurrences of the sequence motifs 5'-ua-3',5'-ca-3' and 5'-ug-3' in either the sense strand, the antisense strand, or both strands is a modified nucleotide. More preferably, all pyrimidine nucleotides in the sense strand are modified nucleotides, and the 5' nucleotide in all occurrences of the sequence motifs 5'-ua-3' and 5'-ca-3' in the antisense strand are modified nucleotides, or where the antisense strand does comprise neither of a 5'-ua-3' and a 5'-ca-3' motif, in all occurrences of the sequence motif 5'-ug-3'.

Preferably, the 2'-modified nucleotides include, for example, a 2'-modified ribose unit, e.g., the 2'-hydroxyl group (OH) can be modified or replaced with a number of different "oxy" or "deoxy" substituents.

Examples of "oxy"-2' hydroxyl group modifications include alkoxy or aryloxy (OR, e.g., R=H, alkyl, cycloalkyl, aryl, aralkyl, heteroaryl or sugar); polyethyleneglycols (PEG), $O(CH_2CH_2O)_nCH_2CH_2$ OR; "locked" nucleic acids (LNA) in which the 2' hydroxyl is connected, e.g., by a methylene bridge, to the 4' carbon of the same ribose sugar; O-AMINE and aminoalkoxy, $O(CH_2)_n$AMINE, (e.g., AMINE=$NH_2$; alkylamino, dialkylamino, heterocyclyl amino, arylamino, diaryl amino, heteroaryl amino, or diheteroaryl amino, ethylene diamine, polyamino). It is noteworthy that oligonucleotides containing only the methoxyethyl group (MOE), ($OCH_2CH_2OCH_3$, a PEG derivative), exhibit nuclease stabilities comparable to those modified with the robust phosphorothioate modification.

"Deoxy" modifications include hydrogen (i.e. deoxyribose sugars, which are of particular relevance to the overhang portions of partially ds RNA); halo (e.g., fluoro); amino (e.g. $NH_2$; alkylamino, dialkylamino, heterocyclyl, arylamino, diaryl amino, heteroaryl amino, diheteroaryl amino, or amino acid); $NH(CH_2CH_2NH)_nCH_2CH_2$-AMINE (AMINE=$NH_2$; alkylamino, dialkylamino, heterocyclyl amino, arylamino, diaryl amino, heteroaryl amino, or diheteroaryl amino), —NHC(O)R(R=alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino functionality.

Preferred substitutents are 2'-methoxyethyl, 2'-$OCH_3$, 2'-O-allyl, 2'-C-allyl, and 2'-fluoro.

The inclusion of furanose sugars in the oligonucleotide backbone can also decrease endonucleolytic cleavage. An iRNA agent can be further modified by including a 3' cationic group, or by inverting the nucleoside at the 3'-terminus with a 3'-3' linkage. In another alternative, the 3'-terminus can be blocked with an aminoalkyl group, e.g., a 3' C5-aminoalkyl dT. Other 3' conjugates can inhibit 3'-5' exonucleolytic cleavage. While not being bound by theory, a 3' conjugate, such as naproxen or ibuprofen, may inhibit exonucleolytic cleavage by sterically blocking the exonuclease from binding to the 3'-end of oligonucleotide. Even small alkyl chains, aryl groups, or heterocyclic conjugates or modified sugars (D-ribose, deoxyribose, glucose etc.) can block 3'-5'-exonucleases.

Nucleolytic cleavage can also be inhibited by the introduction of phosphate linker modifications, e.g., phosphorothioate linkages. Thus, preferred iRNA agents include nucleotide dimers enriched or pure for a particular chiral form of a modified phosphate group containing a heteroatom at a non-bridging position normally occupied by oxygen. The heteroatom can be S, Se, $Nr_2$, or $Br_3$. When the heteroatom is S, enriched or chirally pure Sp linkage is preferred. Enriched means at least 70, 80, 90, 95, or 99% of the preferred form. Modified phosphate linkages are particularly efficient in inhibiting exonucleolytic cleavage when introduced near the 5'- or 3'-terminal positions, and preferably the 5'-terminal positions, of an iRNA agent.

5' conjugates can also inhibit 5'-3' exonucleolytic cleavage. While not being bound by theory, a 5' conjugate, such as naproxen or ibuprofen, may inhibit exonucleolytic cleavage by sterically blocking the exonuclease from binding to the 5'-end of oligonucleotide. Even small alkyl chains, aryl groups, or heterocyclic conjugates or modified sugars (D-ribose, deoxyribose, glucose etc.) can block 3'-5'-exonucleases.

An iRNA agent can have increased resistance to nucleases when a duplexed iRNA agent includes a single-stranded nucleotide overhang on at least one end. In preferred embodiments, the nucleotide overhang includes 1 to 4, preferably 2 to 3, unpaired nucleotides. In a preferred embodiment, the unpaired nucleotide of the single-stranded overhang that is directly adjacent to the terminal nucleotide pair contains a purine base, and the terminal nucleotide pair is a G-C pair, or at least two of the last four complementary nucleotide pairs are G-C pairs. In further embodiments, the nucleotide overhang may have 1 or 2 unpaired nucleotides, and in an exemplary embodiment the nucleotide overhang is 5'-gc-3'. In preferred embodiments, the nucleotide overhang is on the 3'-end of the antisense strand. In one embodiment, the iRNA agent includes the motif 5'-cgc-3' on the 3'-end of the antisense strand, such that a 2-nt overhang 5'-gc-3' is formed.

Thus, an iRNA agent can include modifications so as to inhibit degradation, e.g., by nucleases, e.g., endonucleases or exonucleases, found in the body of a subject. These monomers are referred to herein as NRMs, or Nuclease Resistance promoting Monomers, the corresponding modifications as NRM modifications. In many cases these modifications will modulate other properties of the iRNA agent as well, e.g., the ability to interact with a protein, e.g., a transport protein, e.g., serum albumin, or a member of the RISC, or the ability of the first and second sequences to form a duplex with one another or to form a duplex with another sequence, e.g., a target molecule.

One or more different NRM modifications can be introduced into an iRNA agent or into a sequence of an iRNA agent. An NRM modification can be used more than once in a sequence or in an iRNA agent.

NRM modifications include some which can be placed only at the terminus and others which can go at any position. Some NRM modifications can inhibit hybridization so it is preferable to use them only in terminal regions, and preferable to not use them at the cleavage site or in the cleavage region of a sequence which targets a subject sequence or gene, particularly on the antisense strand. They can be used anywhere in a sense strand, provided that sufficient hybridization between the two strands of the ds iRNA agent is maintained. In some embodiments it is desirable to put the NRM at the cleavage site or in the cleavage region of a sense strand, as it can minimize off-target silencing.

In most cases, NRM modifications will be distributed differently depending on whether they are comprised on a sense or antisense strand. If on an antisense strand, modifications which interfere with or inhibit endonuclease cleavage should not be inserted in the region which is subject to RISC mediated cleavage, e.g., the cleavage site or the cleavage region (As described in Elbashir et al., 2001, Genes and Dev. 15: 188, hereby incorporated by reference). Cleavage of the target occurs about in the middle of a 20 or 21 nt antisense strand, or about 10 or 11 nucleotides upstream of the first nucleotide on the target mRNA which is complementary to the antisense strand. As used herein cleavage site refers to the nucleotides on either side of the cleavage site, on the target or on the iRNA agent strand which hybridizes to it. Cleavage region means the nucleotides within 1, 2, or 3 nucleotides of the cleavages site, in either direction.

Such modifications can be introduced into the terminal regions, e.g., at the terminal position or with 2, 3, 4, or 5 positions of the terminus, of a sense or antisense strand.

Tethered Ligands

The properties of an iRNA agent, including its pharmacological properties, can be influenced and tailored, for example, by the introduction of ligands, e.g. tethered ligands. In addition, pharmacological properties of an iRNA agent can be improved by incorporating a ligand in a formulation of the iRNA agent when the iRNA agent either has or does have a tethered ligand.

A wide variety of entities, e.g., ligands, can be tethered to an iRNA agent or used as formulation conjugate or additive, e.g., to the carrier of a ligand-conjugated monomer subunit. Examples are described below in the context of a ligand-conjugated monomer subunit but that is only preferred, entities can be coupled at other points to an iRNA agent.

Preferred moieties are ligands, which are coupled, preferably covalently, either directly or indirectly, via an intervening tether to the carrier. In preferred embodiments, the ligand is attached to the carrier via an intervening tether. The ligand or tethered ligand may be present on the ligand-conjugated monomer when the ligand-conjugated monomer is incorporated into the growing strand. In some embodiments, the ligand may be incorporated into a "precursor" ligand-conjugated monomer subunit after a "precursor" ligand-conjugated monomer subunit has been incorporated into the growing strand. For example, a monomer having, e.g., an amino-terminated tether, e.g., TAP—$(CH_2)_n NH_2$ may be incorporated into a growing sense or antisense strand. In a subsequent operation, i.e., after incorporation of the precursor monomer subunit into the strand, a ligand having an electrophilic group, e.g., a pentafluorophenyl ester or aldehyde group, can subsequently be attached to the precursor ligand-conjugated monomer by coupling the electrophilic group of the ligand with the terminal nucleophilic group of the precursor ligand-conjugated monomer subunit tether.

In preferred embodiments, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand.

Preferred ligands can improve transport, hybridization, and specificity properties and may also improve nuclease resistance of the resultant natural or modified oligoribonucleotide, or a polymeric molecule comprising any combination of monomers described herein and/or natural or modified ribonucleotides.

Ligands in general can include therapeutic modifiers, e.g., for enhancing uptake; diagnostic compounds or reporter groups e.g., for monitoring distribution; cross-linking agents; nuclease-resistance conferring moieties; and natural or unusual nucleobases. General examples include lipophilic molecules, lipids, lectins, steroids (e.g., uvaol, hecigenin, diosgenin), terpenes (e.g., triterpenes, e.g., sarsasapogenin, Friedelin, epifriedelanol derivatized lithocholic acid), vitamins, carbohydrates (e.g., a dextran, pullulan, chitin, chitosan, synthetic (eg Oligo Lactate 15-mer) and natural (eg low and medium molecular weight) polymers, inulin, cyclodextrin or hyaluronic acid), proteins, protein binding agents, integrin targeting molecules, polycationics, peptides, polyamines, and peptide mimics. Other examples include folic acid or epithelial cell receptor ligands, such as transferin.

The ligand may be a naturally occurring or recombinant or synthetic molecule, such as a synthetic polymer, e.g., a synthetic polyamino acid. Examples of polyamino acids include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacrylic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic moieties, e.g., cationic lipid, cationic porphyrin, quaternary salt of a polyamine, or an alpha helical peptide.

Ligands can also include targeting groups, e.g., a cell or tissue targeting agent, e.g., a thyrotropin, melanotropin, surfactant protein A, mucin carbohydrate, a glycosylated polyaminoacid, transferrin, bisphosphonate, polyglutamate, polyaspartate, or an Arg-Gly-Asp (RGD) peptide or RGD peptide mimetic.

Ligands can be proteins, e.g., glycoproteins, lipoproteins, e.g. low density lipoprotein (LDL), or albumins, e.g. human serum albumin (HSA), or peptides, e.g., molecules having a specific affinity for a co-ligand, or antibodies e.g., an antibody, that binds to a specified cell type such as a cancer cell, endothelial cell, or bone cell. Ligands may also include hormones and hormone receptors. They can also include non-peptidic species, such as cofactors, multivalent lactose, multivalent galactose, N-acetyl-galactosamine, N-acetyl-glucosamine, multivalent mannose, or multivalent fucose.

The ligand can be a substance, e.g., a drug, which can increase the uptake of the iRNA agent into the cell, for example, by disrupting the cell's cytoskeleton, e.g., by disrupting the cell's microtubules, microfilaments, and or intermediate filaments. The drug can be, for example, taxon, vincristine, vinblastine, cytochalasin, nocodazole, japlakinolide, latrunculin A, phalloidin, swinholide A, indanocine, myoservin, tetracyclin.

In one aspect, the ligand is a lipid or lipid-based molecule. Such a lipid or lipid-based molecule preferably binds a serum protein, e.g., human serum albumin (HSA). An HSA binding ligand allows for distribution of the conjugate to a target tissue, e.g., liver tissue, including parenchymal cells of the liver. Other molecules that can bind HSA can also be used as ligands. For example, neproxin or aspirin can be used. A lipid or lipid-based ligand can (a) increase resistance to degradation of the conjugate, (b) increase targeting or transport into a target cell or cell membrane, and or (c) can be used to adjust binding to a serum protein, e.g., HSA.

A lipid based ligand can be used to modulate, e.g., control the binding of the conjugate to a target tissue. For example, a lipid or lipid-based ligand that binds to HSA more strongly will be less likely to be targeted to the kidney and therefore less likely to be cleared from the body.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another aspect, the ligand is a moiety, e.g., a vitamin or nutrient, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include the B vitamins, e.g., folic acid, B12, riboflavin, biotin, pyridoxal or other vitamins or nutrients taken up by cancer cells.

In another aspect, the ligand is a cell-permeation agent, preferably a helical cell-permeation agent. Preferably, the agent is amphipathic. An exemplary agent is a peptide such as tat or antennapedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase. The cell permeation agent can be linked covalently to the iRNA agent or be part of an iRNA-peptide complex.

5'-Phosphate Modifications

In preferred embodiments, iRNA agents are 5' phosphorylated or include a phosphoryl analog at the 5' prime terminus. 5'-phosphate modifications of the antisense strand include those which are compatible with RISC-mediated gene silencing. Suitable modifications include: 5'-monophosphate ((HO)2(O)P—O-5'); 5'-diphosphate ((HO)2(O)P—O-P(HO)(O)—O-5'); 5'-triphosphate ((HO)2(O)P—O—(HO)(O)P—O—P(HO)(O)—O-5'); 5'-guanosine cap (7-methylated or non-methylated) (7m-G-O-5'-(HO)(O)P—O—(HO)(O)P—O—P(HO)(O)—O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)2(S)P—O-5'); 5'-monodithiophosphate (phosphorodithioate; (HO)(HS)(S)P—O-5'), 5'-phosphorothiolate ((HO)2(O)P—S-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)2(O)P—NH-5', (HO)(NH2)(O)P—O-5'), 5'-alkylphosphonates (R=alkyl=methyl, ethyl, isopropyl, propyl, etc., e.g. RP(OH)(O)—O-5'-, (OH)2(O)P-5'-CH2-), 5'-alkyletherphosphonates (R=alkylether=methoxymethyl (MeOCH2-), ethoxymethyl, etc., e.g. RP(OH)(O)—O-5'-).

The sense strand can be modified in order to inactivate the sense strand and prevent formation of an active RISC, thereby potentially reducing off-target effects. This can be accomplished by a modification which prevents 5'-phosphorylation of the sense strand, e.g., by modification with a 5'-O-methyl ribonucleotide (see Nykänen et al., (2001) ATP requirements and small interfering RNA structure in the RNA interference pathway. Cell 107, 309-321.) Other modifications which prevent phosphorylation can also be used, e.g., simply substituting the 5'-OH by H rather than O-Me. Alternatively, a large bulky group may be added to the 5'-phosphate turning it into a phosphodiester linkage.

Non-Natural Nucleobases

Nitropyrrolyl and nitroindolyl are non-natural nucleobases that are members of a class of compounds known as universal bases. Universal bases are those compounds that can replace any of the four naturally occurring bases without substantially affecting the melting behavior or activity of the oligonucleotide duplex. In contrast to the stabilizing, hydrogen-bonding interactions associated with naturally occurring nucleobases, it is postulated that oligonucleotide duplexes containing 3-nitropyrrolyl nucleobases are stabilized solely by stacking interactions. The absence of significant hydrogen-bonding interactions with nitropyrrolyl nucleobases obviates the specificity for a specific complementary base. In addition, various reports confirm that 4-, 5- and 6-nitroindolyl display very little specificity for the four natural bases. Interestingly, an oligonucleotide duplex containing 5-nitroindolyl was more stable than the corresponding oligonucleotides containing 4-nitroindolyl and 6-nitroindolyl. Procedures for the preparation of 1-(2'-O-methyl-β-D-ribofuranosyl)-5-nitroindole are described in Gaubert, G.; Wengel, *J. Tetrahedron Letters* 2004, 45, 5629. Other universal bases amenable to the present invention include hypoxanthinyl, isoinosinyl, 2-aza-inosinyl, 7-deaza-inosinyl, nitroimidazolyl, nitropyrazolyl, nitrobenzimidazolyl, nitroindazolyl, aminoindolyl, pyrrolopyrimidinyl, and structural derivatives thereof. For a more detailed discussion, including synthetic procedures, of nitropyrrolyl, nitroindolyl, and other universal bases mentioned above see Vallone et al., Nucleic Acids Research, 27(17):3589-3596 (1999); Loakes et al., J. Mol. Bio., 270: 426-436 (1997); Loakes et al., Nucleic Acids Research, 22(20):4039-4043 (1994); Oliver et al., Organic Letters, Vol. 3(13):1977-1980 (2001); Amosova et al., Nucleic Acids Research, 25(10):1930-1934 (1997); Loakes et al., Nucleic Acids Research, 29(12):2437-247 (2001); Bergstrom et al., J. Am. Chem. Soc., 117:1201-1209 (1995); Franchetti et al., Biorg. Med. Chem. Lett. 11:67-69 (2001); and Nair et al., Nucelosides, Nucleotides & Nucleic Acids, 20(4-7):735-738 (2001).

Difluorotolyl is a non-natural nucleobase that functions as a universal base. Difluorotolyl is an isostere of the natural nucleobase thymine. But unlike thymine, difluorotolyl shows no appreciable selectivity for any of the natural bases. Other aromatic compounds that function as universal bases and are amenable to the present invention are 4-fluoro-6-methylbenzimidazole and 4-methylbenzimidazole. In addition, the relatively hydrophobic isocarbostyrilyl derivatives 3-methyl isocarbostyrilyl, 5-methyl isocarbostyrilyl, and 3-methyl-7-propynyl isocarbostyrilyl are universal bases which cause only slight destabilization of oligonucleotide duplexes compared to the oligonucleotide sequence containing only natural bases. Other non-natural nucleobases contemplated in the present invention include 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof. For a more detailed discussion, including synthetic procedures, of difluorotolyl, 4-fluoro-6-methylbenzimidazole, 4-methylbenzimidazole, and other non-natural bases mentioned above, see: Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1:1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108.

Transport of iRNA Agents into Cells

Not wishing to be bound by any theory, the chemical similarity between cholesterol-conjugated iRNA agents and certain constituents of lipoproteins (e.g. cholesterol, cholesteryl esters, phospholipids) may lead to the association of iRNA agents with lipoproteins (e.g. LDL, HDL) in blood and or the interaction of the iRNA agent with cellular components having an affinity for cholesterol, e.g. components of the cholesterol transport pathway. Lipoproteins as well as their constituents are taken up and processed by cells by various active and passive transport mechanisms, for example, without limitation, endocytosis of LDL-receptor bound LDL, endocytosis of oxidized or otherwise modified LDLs through interaction with Scavenger receptor A, Scavenger receptor B1-mediated uptake of HDL cholesterol in the liver, pinocytosis, or transport of cholesterol across membranes by ABC (ATP-binding cassette) transporter proteins, e.g. ABC-A1, ABC-G1 or ABC-G4. Hence, cholesterol-conjugated iRNA agents could enjoy facilitated uptake by cells possessing such transport mechanisms, e.g. cells of the liver. As such, the present invention provides evidence and general methods for targeting iRNA agents to cells expressing certain cell surface components, e.g. receptors, by conjugating a natural ligand for such component (e.g. cholesterol) to the iRNA agent, or by conjugating a chemical moiety (e.g. cholesterol) to the iRNA agent which associates with or binds to a natural ligand for the component (e.g. LDL, HDL).

Other Embodiments

An iRNA agent, can be produced in a cell in viva, e.g., from exogenous DNA templates that are delivered into the cell. For example, the DNA templates can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al. Proc. Natl. Acad. Sci. USA 91:3054-3057, 1994). The pharmaceutical preparation of the gene therapy vector can include the gene therapy vector in an acceptable diluent, or can comprise a slow release matrix in which the gene delivery vehicle is imbedded. The DNA templates, for example, can include two transcription units, one that produces a transcript that includes the top strand of an iRNA agent and one that produces a transcript that includes the bottom strand of an iRNA agent. When the templates are transcribed, the iRNA agent is produced, and processed into siRNA agent fragments that mediate gene silencing.

Formulation

The present invention also includes pharmaceutical compositions and formulations which include the dsRNA compounds of the invention. The pharmaceutical compositions of the present invention may be administered in a number of ways depending upon whether local or systemic treatment is desired and upon the area to be treated. Administration may be topical, pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; or intracranial, e.g., intrathecal or intraventricular, administration.

Pharmaceutical compositions and formulations for topical administration may include transdermal patches, ointments, lotions, creams, gels, drops, suppositories, sprays, liquids and powders. Conventional pharmaceutical carriers, aqueous, powder or oily bases, thickeners and the like may be necessary or desirable. Coated condoms, gloves and the like may also be useful. Preferred topical formulations include those in which the dsRNAs of the invention are in admixture with a topical delivery agent such as lipids, liposomes, fatty acids, fatty acid esters, steroids, chelating agents and surfactants. Preferred lipids and liposomes include neutral (e.g. dioleoylphosphatidyl ethanolamine=DOPE, dimyristoylphosphatidyl choline=DMPC, distearolyphosphatidyl choline) negative (e.g. dimyristoylphosphatidyl glycerol=DMPG) and cationic (e.g. dioleoyltetramethyl-aminopropyl=DOTAP and dioleoylphosphatidyl ethanolamine=DOTMA), e.g. (+/−)-N-(3-aminopropyl)-N,N-dimethyl-2,3-bis(dodecyloxy)-1-propanaminium bromide=GAP-DLRIE). DsRNAs of the invention may be encapsulated within liposomes or may form complexes thereto, in particular to cationic liposomes. Alternatively, dsRNAs may be complexed to lipids, in particular to cationic lipids. Preferred fatty acids and esters include but are not limited arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcamitine, an acylcholine, or a $C_{1-10}$ alkyl ester (e.g. isopropylmyristate IPM), monoglyceride, diglyceride or pharmaceutically acceptable salt thereof. Topical formulations are described in detail in U.S. patent application Ser. No. 09/315,298 filed on May 20, 1999 which is incorporated herein by reference in its entirety.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders may be desirable. Preferred oral formulations are those in which dsRNAs of the invention are administered in conjunction with one or more penetration enhancers, surfactants, and chelators. Preferred surfactants include fatty acids and or esters or salts thereof, bile acids and/or salts thereof. Preferred bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Preferred fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g. sodium). Also preferred are combinations of penetration enhancers, for example, fatty acids/salts in combination with bile acids/salts. A particularly preferred combination is the sodium salt of lauric acid, capric acid and UDCA. Further penetration enhancers include polyoxyethylene-9-lauryl ether, polyoxyethylene-20-cetyl ether. DsRNAs of the invention may be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Particularly preferred complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g. p-amino), poly (methylcyanoacrylate), poly(ethylcyanoacrylate), poly(butylcyanoacrylate), poly(isobutyl cyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly (D,L-lactic acid), poly(DL-lactic-co-glycolic acid (PLGA), alginate, and polyethyleneglycol (PEG). Oral formulations for dsRNAs and their preparation are described in detail in U.S. application. Ser. No. 08/886,829 (filed Jul. 1, 1997), Ser. No. 09/108,673 (filed Jul. 1, 1998), Ser. No. 09/256,515 (filed Feb. 23, 1999), Ser. No. 09/082,624 (filed May 21, 1998) and Ser. No. 09/315,298 (filed May 20, 1999), each of which is incorporated herein by reference in their entirety.

Compositions and formulations for parenteral, intrathecal or intraventricular administration may include sterile aqueous solutions which may also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical formulations of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, gel capsules, liquid syrups, soft gels, suppositories, and enemas. The compositions of the present invention may also be formulated as suspensions in aqueous, non-aqueous or mixed media. Aqueous suspensions may further contain substances which increase the viscosity of the suspension including, for example, sodium carboxymethylcellulose, sorbitol and/or dextran. The suspension may also contain stabilizers.

In one embodiment of the present invention the pharmaceutical compositions may be formulated and used as foams. Pharmaceutical foams include formulations such as, but not limited to, emulsions, microemulsions, creams, jellies and liposomes. While basically similar in nature these formulations vary in the components and the consistency of the final product. The preparation of such compositions and formulations is generally known to those skilled in the pharmaceutical and formulation arts and may be applied to the formulation of the compositions of the present invention.

Emulsions

The compositions of the present invention may be prepared and formulated as emulsions. Emulsions are typically heterogenous systems of one liquid dispersed in another in the form of droplets usually exceeding 0.1 μm in diameter (Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions may be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions may contain additional components in addition to the dispersed phases, and the active drug which may be present as a solution in either the aqueous phase, oily phase or itself as a separate phase. Pharmaceutical excipients such as emulsifiers, stabilizers, dyes, and anti-oxidants may also be present in emulsions as needed. Pharmaceutical emulsions may also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion may be a semisolid or a solid, as is the case of emulsion-style ointment bases and creams. Other means of stabilizing emulsions entail the use of emulsifiers that may be incorporated into either phase of the emulsion. Emulsifiers may broadly be classified into four categories: synthetic surfactants, naturally occurring emulsifiers, absorption bases, and finely dispersed solids (Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants may be classified into different classes based on the nature of the hydrophilic group: nonionic, anionic, cationic and amphoteric (Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., vol. 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that may readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used may be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (Rosoff, in Pharmaceutical Dosage Forms, Lieberman, Rieger and Banker (Eds.), 1988, Marcel Dekker, Jnc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

In one embodiment of the present invention, the compositions of dsRNAs and nucleic acids are formulated as microemulsions. A microemulsion may be defined as a system of water, oil and amphiphile which is a single optically isotropic and thermodynamically stable liquid solution (Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions may, however, be prepared without the use of cosurfactants and alcohol-free self-emulsifying microemulsion systems are known in the art. The aqueous phase may typically be, but is not limited to, water, an aqueous solution of the drug, glycerol, PEG300, PEG400, polyglycerols, propylene glycols, and derivatives of ethylene glycol. The oil phase may include, but is not limited to, materials such as Captex 300, Captex 355, Capmul MCM, fatty acid esters, medium chain ($C_8$-$C_{12}$) mono, di, and tri-glycerides, polyoxyethylated glyceryl fatty acid esters, fatty alcohols, polyglycolized glycerides, saturated polyglycolized $C_8$-$C_{10}$ glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (Constantinides et al., Pharmaceutical Research, 1994, 11, 1385; Ho et al., J. Pharm. Sci., 1996, 85, 138-143). Often microemulsions may form spontaneously when their components are brought together at ambient temperature. This may be particularly advantageous when formulating thermolabile drugs, peptides or dsRNAs. Microemulsions have also been effective in the transdermal delivery of active components in both cosmetic and pharmaceutical applications. It is expected that the microemulsion compositions and formulations of the present invention will facilitate the increased systemic absorption of dsRNAs and nucleic acids from the gastrointestinal tract, as well as improve the local cellular uptake of dsRNAs and nucleic acids within the gastrointestinal tract, vagina, buccal cavity and other areas of administration.

Microemulsions of the present invention may also contain additional components and additives such as sorbitan monostearate (Grill 3), Labrasol, and penetration enhancers to improve the properties of the formulation and to enhance the absorption of the dsRNAs and nucleic acids of the present invention. Penetration enhancers used in the microemulsions of the present invention may be classified as belonging to one of five broad categories surfactants, fatty acids, bile salts, chelating agents, and non-chelating non-surfactants (Lee et al., Critical Reviews in Therapeutic Drug Carrier Systems, 1991, p. 92). Each of these classes has been discussed above.

Liposomes

There are many organized surfactant structures besides microemulsions that have been studied and used for the formulation of drugs. These include monolayers, micelles, bilayers and vesicles. Vesicles, such as liposomes, have attracted great interest because of their specificity and the duration of action they offer from the standpoint of drug delivery. As used in the present invention, the term "liposome" means a vesicle composed of amphiphilic lipids arranged in a spherical bilayer or bilayers.

Liposomes are unilamellar or multilamellar vesicles which have a membrane formed from a lipophilic material and an aqueous interior. The aqueous portion contains the composition to be delivered. Cationic liposomes possess the advantage of being able to fuse to the cell wall. Non-cationic liposomes, although not able to fuse as efficiently with the cell membrane, are taken up by macrophages in vivo.

In order to cross intact mammalian skin, lipid vesicles must pass through a series of fine pores, each with a diameter less than 50 nm, under the influence of a suitable transdermal gradient. Therefore, it is desirable to use a liposome which is highly deformable and able to pass through such fine pores.

Further advantages of liposomes include; liposomes obtained from natural phospholipids are biocompatible and biodegradable; liposomes can incorporate a wide range of water and lipid soluble drugs; liposomes can protect encapsulated drugs in their internal compartments from metabolism and degradation (Rosoff, in Pharmaceutical Dosage Forms, Lieberman, Rieger and Banker (Eds.), 1988, Marcel Dekker, Inc., New York, N.Y., volume 1, p. 245). Important considerations in the preparation of liposome formulations are the lipid surface charge, vesicle size and the aqueous volume of the liposomes.

Liposomes are useful for the transfer and delivery of active ingredients to the site of action. Because the liposomal membrane is structurally similar to biological membranes, when liposomes are applied to a tissue, the liposomes start to merge with the cellular membranes and as the merging of the liposome and cell progresses, the liposomal contents are emptied into the cell where the active agent may act.

Liposomal formulations have been the focus of extensive investigation as the mode of delivery for many drugs. There is growing evidence that for topical administration, liposomes present several advantages over other formulations. Such advantages include reduced side-effects related to high systemic absorption of the administered drug, increased accumulation of the administered drug at the desired target, and the ability to administer a wide variety of drugs, both hydrophilic and hydrophobic, into the skin.

Several reports have detailed the ability of liposomes to deliver agents including high-molecular weight DNA into the skin. Compounds including analgesics, antibodies, hormones and high-molecular weight DNAs have been administered to the skin. The majority of applications resulted in the targeting of the upper epidermis Liposomes fall into two broad classes. Cationic liposomes are positively charged liposomes which interact with the negatively charged DNA molecules to form a stable complex. The positively charged DNA/liposome complex binds to the negatively charged cell surface and is internalized in an endosome. Due to the acidic pH within the endosome, the liposomes are ruptured, releasing their contents into the cell cytoplasm (Wang et al., Biochem. Biophys. Res. Commun., 1987, 147, 980-985).

Liposomes which are pH-sensitive or negatively-charged, entrap DNA rather than complex with it. Since both the DNA and the lipid are similarly charged, repulsion rather than complex formation occurs. Nevertheless, some DNA is entrapped within the aqueous interior of these liposomes. pH-sensitive liposomes have been used to deliver DNA encoding the thymidine kinase gene to cell monolayers in culture. Expression of the exogenous gene was detected in the target cells (Zhou et al., Journal of Controlled Release, 1992, 19, 269-274).

One major type of liposomal composition includes phospholipids other than naturally derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and or cholesterol.

Several studies have assessed the topical delivery of liposomal drug formulations to the skin. Application of liposomes containing interferon to guinea pig skin resulted in a reduction of skin herpes sores while delivery of interferon via other means (e.g. as a solution or as an emulsion) were ineffective (Weiner et al., Journal of Drug Targeting, 1992, 2, 405-410). Further, an additional study tested the efficacy of interferon administered as part of a liposomal formulation to the administration of interferon using an aqueous system, and concluded that the liposomal formulation was superior to aqueous administration (du Plessis et al., Antiviral Research, 1992, 18, 259-265).

Non-ionic liposomal systems have also been examined to determine their utility in the delivery of drugs to the skin, in particular systems comprising non-ionic surfactant and cholesterol. Non-ionic liposomal formulations comprising Novasome.™. I (glyceryl dilaurate/cholesterol/polyoxyethylene-10-stearyl ether) and Novasome.™. II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporin-A into different layers of the skin (Hu et al. S. T. P. Pharma. Sci., 1994, 4, 6, 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_m1$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., FEBS Letters, 1987, 223, 42; Wu et al., Cancer Research, 1993, 53, 3765).

Various liposomes comprising one or more glycolipids are known in the art. Papahadjopoulos et al. (Ann. N.Y. Acad. Sci., 1987, 507, 64) reported the ability of monosialoganglioside $G_m1$, galactocerebroside sulfate and phosphatidylinositol to improve blood half-lives of liposomes. These findings were expounded upon by Gabizon et al. (Proc. Natl. Acad. Sci. U.S.A., 1988, 85, 6949). U.S. Pat. No. 4,837,028 and WO 88/04924, both to Allen et al., disclose liposomes comprising (1) sphingomyelin and (2) the ganglioside $G_m1$ or a galactocerebroside sulfate ester. U.S. Pat. No. 5,543,152 (Webb et al.) discloses liposomes comprising sphingomyelin. Liposomes comprising 1,2-sn-dimyristoylphosphat-idylcholine are disclosed in WO 97/13499 (Lim et al).

Many liposomes comprising lipids derivatized with one or more hydrophilic polymers, and methods of preparation thereof, are known in the art. Sunamoto et al. (Bull. Chem. Soc. Jpn., 1980, 53, 2778) described liposomes comprising a nonionic detergent, $2C_{1215G}$, that contains a PEG moiety. Illum et al. (FEBS Lett., 1984, 167, 79) noted that hydrophilic coating of polystyrene particles with polymeric glycols results in significantly enhanced blood half-lives. Synthetic phospholipids modified by the attachment of carboxylic groups of polyalkylene glycols (e.g., PEG) are described by Sears (U.S. Pat. Nos. 4,426,330 and 4,534,899). Klibanov et al. (FEBS Lett., 1990, 268, 235) described experiments demonstrating that liposomes comprising phosphatidylethanolamine (PE) derivatized with PEG or PEG stearate have significant increases in blood circulation half-lives. Blume et al. (Biochimica et Biophysica Acta, 1990, 1029, 91) extended such observations to other PEG-derivatized phospholipids, e.g., DSPE-PEG, formed from the combination of distearoylphosphatidylethanolamine (DSPE) and PEG. Liposomes having covalently bound PEG moieties on their external surface are described in European Patent No. EP 0 445 131 B1 and WO 90/04384 to Fisher. Liposome compositions containing 1-20 mole percent of PE derivatized with PEG, and methods of use thereof, are described by Woodle et al. (U.S. Pat. Nos. 5,013,556 and 5,356,633) and Martin et al. (U.S. Pat. No. 5,213,804 and European Patent No. EP 0 496 813 B1). Liposomes comprising a number of other lipid-polymer conjugates are disclosed in WO 91/05545 and U.S. Pat. No. 5,225,212 (both to Martin et al.) and in WO 94/20073 (Zalipsky et al.) Liposomes comprising PEG-modified ceramide lipids are described in WO 96/10391 (Choi et al). U.S. Pat. No. 5,540,935 (Miyazaki et al.) and U.S. Pat. No. 5,556,948 (Tagawa et al.) describe PEG-containing liposomes that can be further derivatized with functional moieties on their surfaces.

A limited number of liposomes comprising nucleic acids are known in the art. WO 96/40062 to Thierry et al. discloses methods for encapsulating high molecular weight nucleic acids in liposomes. U.S. Pat. No. 5,264,221 to Tagawa et al. discloses protein-bonded liposomes and asserts that the contents of such liposomes may include dsRNA. U.S. Pat. No. 5,665,710 to Rahman et al. describes certain methods of encapsulating oligodeoxynucleotides in liposomes. WO 97/04787 to Love et al. discloses liposomes comprising dsRNAs targeted to the raf gene.

Transfersomes are yet another type of liposomes, and are highly deformable lipid aggregates which are attractive candidates for drug delivery vehicles. Transfersomes may be described as lipid droplets which are so highly deformable that they are easily able to penetrate through pores which are smaller than the droplet. Transfersomes are adaptable to the environment in which they are used, e.g. they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile lipophile balance (HLB). The nature of the hydrophilic group (also known as the "head") provides the most useful means for categorizing the different surfactants used in formulations (Rieger, in Pharmaceutical Dosage Forms, Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in Pharmaceutical Dosage Forms, Marcel Dekker, Inc., New York, N.Y., 1988, p. 285).

Penetration Enhancers

In one embodiment, the present invention employs various penetration enhancers to effect the efficient delivery of nucleic acids, particularly dsRNAs, to the skin of animals. Most drugs are present in solution in both ionized and non-ionized forms. However, usually only lipid soluble or lipophilic drugs readily cross cell membranes. It has been discovered that even non-lipophilic drugs may cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers may be classified as belonging to one of five broad categories, i.e., surfactants, fatty acids, bile salts, chelating agents, and non-chelating non-surfactants (Lee et al., Critical Reviews in Therapeutic Drug Carrier Systems, 1991, p. 92). Each of the above mentioned classes of penetration enhancers are described below in greater detail.

Surfactants: In connection with the present invention, surfactants (or "surface-active agents") are chemical entities which, when dissolved in an aqueous solution, reduce the surface tension of the solution or the interfacial tension between the aqueous solution and another liquid, with the result that absorption of dsRNAs through the mucosa is enhanced. In addition to bile salts and fatty acids, these penetration enhancers include, for example, sodium lauryl sulfate, polyethylene-9-lauryl ether and polyoxyethylene-20-cetyl ether) (Lee et al., Critical Reviews in Therapeutic Drug Carrier Systems, 1991, p. 92); and perfluorochemical emulsions, such as FC-43 (Takahashi et al., J. Pharm. Pharmacol., 1988, 40, 252).

Fatty acids: Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, $C_1$-$C_{10}$ alkyl esters thereof (e.g., methyl, isopropyl and t-butyl), and mono- and di-glycerides thereof (i.e., oleate, laurate, caprate, myristate, palmitate, stearate, linoleate, etc.) (Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

Bile salts: The physiological role of bile includes the facilitation of dispersion and absorption of lipids and fat-soluble vitamins (Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. The bile salts of the invention include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating Agents: Chelating agents, as used in connection with the present invention, can be defined as compounds that remove metallic ions from solution by forming complexes therewith, with the result that absorption of dsRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Chelating agents of the invention include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

Non-chelating non-surfactants: As used herein, non-chelating non-surfactant penetration enhancing compounds can be defined as compounds that demonstrate insignificant activity as chelating agents or as surfactants but that nonetheless enhance absorption of dsRNAs through the alimentary mucosa (Muranishi, Critical Reviews in Therapeutic Drug Carrier Systems, 1990, 7, 1-33). This class of penetration enhancers include, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., J. Pharm. Pharmacol., 1987, 39, 621-626).

Agents that enhance uptake of dsRNAs at the cellular level may also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT App WO 97/30731) and other peptides, are also known to enhance the cellular uptake of dsRNAs.

Other agents may be utilized to enhance the penetration of the administered nucleic acids, including glycols such as ethylene glycol and propylene glycol, pyrrols such as 2-pyrrol, azones, and terpenes such as limonene and menthone.

Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., Antisense Res. Dev., 1995, 5, 115-121 Takakura et al., Antisense & Nucl. Acid Drug Dev., 1996, 6, 177-183.

Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient may be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipient suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids may include sterile and non-sterile aqueous solutions, non-aqueous solutions in common solvents such as alcohols, or solutions of the nucleic acids in liquid or solid oil bases. The solutions may also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

Pharmaceutical Compositions for the Delivery to the Respiratory Tract

Another aspect of the invention provides for the delivery of iRNA agents to the respiratory tract, particularly for the treatment of cystic fibrosis. The respiratory tract includes the upper airways, including the oropharynx and larynx, followed by the lower airways, which include the trachea followed by bifurcations into the bronchi and bronchioli. The upper and lower airways are called the conductive airways. The terminal bronchioli then divide into respiratory bronchioli which then lead to the ultimate respiratory zone, the alveoli, or deep lung. The epithelium of the conductive airways is the primary target of inhaled therapeutic aerosols for delivery of iRNA agents such as alpha-ENaC iRNA agents.

Pulmonary delivery compositions can be delivered by inhalation by the patient of a dispersion so that the composition, preferably the iRNA agent, within the dispersion can reach the lung where it can, for example, be readily absorbed through the alveolar region directly into blood circulation. Pulmonary delivery can be effective both for systemic delivery and for localized delivery to treat diseases of the lungs.

Pulmonary delivery can be achieved by different approaches, including the use of nebulized, aerosolized, micellular and dry powder-based formulations; administration by inhalation may be oral and or nasal. Delivery can be achieved with liquid nebulizers, aerosol-based inhalers, and dry powder dispersion devices. Metered-dose devices are preferred. One of the benefits of using an atomizer or inhaler is that the potential for contamination is minimized because the devices are self contained. Dry powder dispersion devices, for example, deliver drugs that may be readily formulated as dry powders. An iRNA composition may be stably stored as lyophilized or spray-dried powders by itself or in combination with suitable powder carriers. The delivery of a composition for inhalation can be mediated by a dosing timing element which can include a timer, a dose counter, time measuring device, or a time indicator which when incorporated into the device enables dose tracking, compliance monitoring, and or dose triggering to a patient during administration of the aerosol medicament.

Examples of pharmaceutical devices for aerosol delivery include metered dose inhalers (MDIs), dry powder inhalers (DPIs), and air-jet nebulizers. Exemplary delivery systems by inhalation which can be readily adapted for delivery of the subject iRNA agents are described in, for example, U.S. Pat. Nos. 5,756,353; 5,858,784; and PCT applications WO98/31346; WO98/10796; WO00/27359; WO01/54664; WO02/060412. Other aerosol formulations that may be used for delivering the iRNA agents are described in U.S. Pat. Nos. 6,294,153; 6,344,194; 6,071,497, and PCT applications WO02/066078; WO02/053190; WO01/60420; WO00/66206. Further, methods for delivering iRNA agents can be adapted from those used in delivering other oligonucleotides (e.g., an antisense oligonucleotide) by inhalation, such as described in Templin et al., Antisense Nucleic Acid Drug Dev, 2000, 10:359-68; Sandrasagra et al., Expert Opin Biol Ther, 2001, 1:979-83; Sandrasagra et al., Antisense Nucleic Acid Drug Dev, 2002, 12:177-81.

The delivery of the inventive agents may also involve the administration of so called "pro-drugs", i.e. formulations or chemical modifications of a therapeutic substance that require some form of processing or transport by systems innate to the subject organism to release the therapeutic substance, preferably at the site where its action is desired; this latter embodiment may be used in conjunction with delivery of the respiratory tract, but also together with other embodiments of the present invention. For example, the human lungs can remove or rapidly degrade hydrolytically cleavable deposited aerosols over periods ranging from minutes to hours. In the upper airways, ciliated epithelia contribute to the "mucociliary excalator" by which particles are swept from the airways toward the mouth. Pavia, D., "Lung Mucociliary Clearance," in Aerosols and the Lung: Clinical and Experimental Aspects, Clarke, S. W. and Pavia, D., Eds., Butterworths, London, 1984. In the deep lungs, alveolar macrophages are capable of phagocytosing particles soon after their deposition. Warheit et al. Microscopy Res. Tech., 26: 412-422 (1993); and Brain, J. D., "Physiology and Pathophysiology of Pulmonary Macrophages," in The Reticuloendothelial System, S. M. Reichard and J. Filkins, Eds., Plenum, New. York., pp. 315-327, 1985.

In preferred embodiments, particularly where systemic dosing with the iRNA agent is desired, the aerosoled iRNA agents are formulated as microparticles. Microparticles having a diameter of between 0.5 and ten microns can penetrate the lungs, passing through most of the natural barriers. A diameter of less than ten microns is required to bypass the throat; a diameter of 0.5 microns or greater is required to avoid being exhaled.

Other Components

Compositions of the present invention may additionally contain other adjunct components conventionally found in pharmaceutical compositions, at their art-established usage levels. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and or aromatic substances and the like which do not deleteriously interact with the nucleic acid(s) of the formulation.

Aqueous suspensions may contain substances which increase the viscosity of the suspension including, for example, sodium carboxymethylcellulose, sorbitol and or dextran. The suspension may also contain stabilizers.

Certain embodiments of the invention provide pharmaceutical combinations and compositions containing (a) one or more dsRNA agents and (b) one or more other therapeutic agents which function by a non-RNA interference mechanism.

Accordingly, the invention includes a combination of an iRNA of the present invention with an anti-inflammatory, bronchodilatory, antihistamine, anti-tussive, antibiotic or DNase drug substance, said epithelial sodium channel blocker and said drug substance being in the same or different pharmaceutical composition.

Suitable antibiotics include macrolide antibiotics, e.g., tobramycin (TOBI™).

Suitable DNase drug substances include dornase alfa (Pulmozyme™), a highly-purified solution of recombinant human deoxyribonuclease I (rhDNase), which selectively cleaves DNA. Dornase alfa is used to treat cystic fibrosis.

Other useful combinations of epithelial sodium channel blockers with anti-inflammatory drugs are those with antagonists of chemokine receptors, e.g., CCR-1, CCR-2, CCR-3, CCR-4, CCR-5, CCR-6, CCR-7, CCR-8, CCR-9 and CCR10, CXCR1, CXCR2, CXCR3, CXCR4, CXCR5, particularly CCR-5 antagonists, such as Schering-Plough antagonists SC-351125, SCH-55700 and SCH-D; Takeda antagonists, such as N-[[4-[[[6,7-dihydro-2-(4-methyl-phenyl)-5H-benzo-cyclohepten-8-yl]carbonyl]amino]phenyl]-methyl]tetrahydro-N,N-dimethyl-2H-pyran-4-amin-ium chloride (TAK-7701; and CCR-5 antagonists described in U.S. Pat. No. 6,166,037 (particularly claims 18 and 19), WO 00/66558 (particularly claim 8), WO 00/66559 (particularly claim 9), WO 04/018425 and WO 04/026873.

Suitable anti-inflammatory drugs include steroids, in particular, glucocorticosteroids, such as budesonide, beclamethasone dipropionate, fluticasone propionate, ciclesonide or mometasone furoate, or steroids described in WO 02/88167, WO 02/12266, WO 02/100879, WO 02/00679 (especially those of Examples 3, 11, 14, 7, 19, 26, 34, 37, 39, 51, 60, 67, 72, 73, 90, 99 and 101), WO 03/35668, WO 03/48181, WO 03/62259, WO 03/64445, WO 03/72592, WO 04/39827 and WO 04/66920; non-steroidal glucocorticoid receptor agonists, such as those described in DE 10261874, WO 00/00531, WO 02/10143, WO 03/82280, WO 03/82787, WO 03/86294, WO 03/104195, WO 03/101932, WO 04/05229, WO 04/18429, WO 04/19935 and WO 04/26248; LTD antagonists, such as montelukast and zafirlukast; PDE4 inhibitors, such as cilomilast (Ariflo® GlaxoSmithKline), Roflumilast (Byk Gulden), V-11294A (Napp), BAY19-8004 (Bayer), SCH-351591 (Schering-Plough), Arofylline (Almirall Prodesfarma), PD189659/PD168787 (Parke-Davis), AWD-12-281 (Asta Medica), CDC-801 (Celgene), SelCID™ CC-10004 (Celgene), VM554/UM565 (Vernalis), T-440 (Tanabe), KW-4490 (Kyowa Hakko Kogyo), and those disclosed in WO 92/19594, WO 93/19749, WO 93/19750, WO 93/19751, WO 98/18796, WO 99/16766, WO 01/13953, WO 03/104204, WO 03/104205, WO 03/39544, WO 04/000814, WO 04/000839, WO 04/005258, WO 04/018450, WO 04/018451, WO 04/018457, WO 04/018465, WO 04/018431, WO 04/0189, WO 04/018450, WO 04/018451, WO 04/018457, WO 04/018465, WO 04/019944, WO 04/019945, WO 04/045607 and WO 04/037805; adenosine A2B receptor antagonists such as those described in WO 02/42298; and beta-2 adrenoceptor agonists, such as albuterol (salbutamol), metaproterenol, terbutaline, salmeterol fenoterol, procaterol, and especially, formoterol, carmoterol and pharmaceutically acceptable salts thereof, and compounds (in free or salt or solvate form) of formula (I) of WO 0075114, which document is incorporated herein by reference, preferably compounds of the Examples thereof, especially indacaterol and pharmaceutically acceptable salts thereof, as well as compounds (in free or salt or solvate form) of formula (I) of WO 04/16601, and also compounds of EP 1440966, JP 05025045, WO 93/18007, WO 99/64035, USP 2002/0055651, WO 01/42193, WO 01/83462, WO 02/66422, WO 02/70490, WO 02/76933, WO 03/239, WO 03/42160, WO 03/42164, WO 03/72539, WO 03/91204, WO 03/99764, WO 04/16578, WO 04/22547, WO 04/32921, WO 04/33412, WO 04/37768, WO 04/37773, WO 04/37807, WO 04/39762, WO 04/39766, WO 04/45618, WO 04/46083, WO 04/80964, WO 04/108765 and WO 04/108676.

Suitable bronchodilatory drugs include anticholinergic or antimuscarinic agents, in particular, ipratropium bromide, oxitropium bromide, tiotropium salts and CHF 4226 (Chiesi), and glycopyrrolate, but also those described in EP 424021, U.S. Pat. No. 3,714,357, U.S. Pat. No. 5,171,744, WO 01/04118, WO 02/00652, WO 02/51841, WO 02/53564, WO 03/00840, WO 03/33495, WO 03/53966, WO 03/87094, WO 04/018422 and WO 04/05285.

Suitable dual anti-inflammatory and bronchodilatory drugs include dual beta-2 adrenoceptor agonist/muscarinic antagonists such as those disclosed in USP 2004/0167167, WO 04/74246 and WO 04/74812.

Suitable antihistamine drug substances include cetirizine hydrochloride, acetaminophen, clemastine fumarate, promethazine, loratidine, desloratidine, diphenhydrarmine and fexofenadine hydrochloride, activastine, astemizole, azelastine, ebastine, epinastine, mizolastine and tefenadine, as well as those disclosed in JP 2004107299, WO 03/099807 and WO 04/026841.

Other useful combinations of agents of the invention with anti-inflammatory drugs are those with antagonists of chemokine receptors, e.g., CCR-1, CCR-2, CCR-3, CCR-4, CCR-5, CCR-6, CCR-7, CCR-8, CCR-9 and CCR10, CXCR1, CXCR2, CXCR3, CXCR4, CXCR5, particularly CCR-5 antagonists, such as Schering-Plough antagonists SC-351125, SCH-55700 and SCH-D; Takeda antagonists, such as N-[[4-[[[6,7-dihydro-2-(4-methylphenyl)-5H-benzocyclohepten-8-yl]carbonyl]amino]phenyl]-methyl]tetrahydro-N,N-dimethyl-2H-pyran-4-amin-ium chloride (TAK-770), and CCR-5 antagonists described in U.S. Pat. No. 6,166,037 (particularly claims 18 and 19), WO 00/66558 (particularly claim 8), WO 00/66559 (particularly claim 9), WO 04/018425 and WO 04/026873.

Other useful additional therapeutic agents may also be selected from the group consisting of cytokine binding molecules, particularly antibodies of other cytokines, in particular a combination with an anti-IL4 antibody, such as described in PCT EP2005/00836, an anti-IgE antibody, such as Xolair®, an anti-IL31 antibody, an anti-IL31R antibody, an anti-TSLP antibody, an anti-TSLP receptor antibody, an anti-endoglin antibody, an anti-IL1b antibody or an anti-IL13 antibody, such as described in WO05/007699.

Two or more combined compounds may be used together in a single formulation, separately, concomitantly or sequentially.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred.

The data obtained from cell culture assays and animal studies can be used in formulating a range of dosage for use in humans. The dosage of compositions of the invention lies generally within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

In addition to their administration individually or as a plurality, as discussed above, the dsRNAs of the invention can be administered in combination with other known agents effective in treatment of ENaC related disorders. In any event, the administering physician can adjust the amount and timing of dsRNA administration on the basis of results observed using standard measures of efficacy known in the art or described herein.

Treatment Methods and Routes of Delivery

A composition that includes an iRNA agent, e.g., an iRNA agent that targets alpha-ENaC, can be delivered to a subject by a variety of routes to achieve either local delivery to the site of action or systemic delivery to the subject. Exemplary routes include direct local administration to the site of treatment, such as the lungs and nasal passage as well as intravenous, nasal, oral, and ocular delivery. The preferred means of administering the iRNA agents of the present invention is through direct administration to the lungs and nasal passage as a liquid, aerosol or nebulized solution.

Formulations for inhalation or parenteral administration are well known in the art. Such formulation may include sterile aqueous solutions which may also contain buffers, diluents and other suitable additives. For intravenous use, the total concentration of solutes should be controlled to render the preparation isotonic.

The active compounds disclosed herein are preferably administered to the lung(s) or nasal passage of a subject by any suitable means. Active compounds may be administered by administering an aerosol suspension of respirable particles comprised of the active compound or active compounds, which the subject inhales. The active compound can be aerosolized in a variety of forms, such as, but not limited to, dry powder inhalants, metered dose inhalants, or liquid suspensions. The respirable particles may be liquid or solid. The particles may optionally contain other therapeutic ingredients such as amiloride, benzamil or phenamil, with the selected compound included in an amount effective to inhibit the reabsorption of water from airway mucous secretions, as described in U.S. Pat. No. 4,501,729.

The particulate pharmaceutical composition may optionally be combined with a carrier to aid in dispersion or transport. A suitable carrier such as a sugar (i.e., lactose, sucrose, trehalose, mannitol) may be blended with the active compound or compounds in any suitable ratio (e.g., a 1 to 1 ratio by weight).

Particles comprised of the active compound for practicing the present invention should include particles of respirable size, that is, particles of a size sufficiently small to pass through the mouth or nose and larynx upon inhalation and into the bronchi and alveoli of the lungs. In general, particles ranging from about 1 to 10 microns in size (more particularly, less than about 5 microns in size) are respirable. Particles of non-respirable size which are included in the aerosol tend to deposit in the throat and be swallowed, and the quantity of non-respirable particles in the aerosol is preferably minimized. For nasal administration, a particle size in the range of 10-500 uM is preferred to ensure retention in the nasal cavity.

Liquid pharmaceutical compositions of active compound for producing an aerosol may be prepared by combining the active compound with a suitable vehicle, such as sterile pyrogen free water. The hypertonic saline solutions used to carry out the present invention are preferably sterile, pyrogen-free solutions, comprising from one to fifteen percent (by weight) of the physiologically acceptable salt, and more preferably from three to seven percent by weight of the physiologically acceptable salt.

Aerosols of liquid particles comprising the active compound may be produced by any suitable means, such as with a pressure-driven jet nebulizer or an ultrasonic nebulizer. See, e.g., U.S. Pat. No. 4,501,729. Nebulizers are commercially available devices which transform solutions or suspensions of the active ingredient into a therapeutic aerosol mist either by means of acceleration of compressed gas, typically air or oxygen, through a narrow venturi orifice or by means of ultrasonic agitation.

Suitable formulations for use in nebulizers consist of the active ingredient in a liquid carrier, the active ingredient comprising up to 40% w/w of the formulation, but preferably less than 20% w/w. The carrier is typically water (and most preferably sterile, pyrogen-free water) or a dilute aqueous alcoholic solution, preferably made isotonic, but may be hypertonic with body fluids by the addition of, for example, sodium chloride. Optional additives include preservatives if the formulation is not made sterile, for example, methyl hydroxybenzoate, antioxidants, flavoring agents, volatile oils, buffering agents and surfactants.

Aerosols of solid particles comprising the active compound may likewise be produced with any solid particulate therapeutic aerosol generator. Aerosol generators for administering solid particulate therapeutics to a subject produce particles which are respirable and generate a volume of aerosol containing a predetermined metered dose of a therapeutic at a rate suitable for human administration. One Dosage An iRNA agent can be administered at a unit dose less than about 75 mg per kg of bodyweight, or less than about 70, 60, 50, 40, 30, 20, 10, 5, 2, 1, 0.5, 0.1, 0.05, 0.01, 0.005, 0.001, or 0.0005 mg per kg of bodyweight, and less than 200 nmol of iRNA agent (e.g., about $4.4 \times 10^{16}$ copies) per kg of bodyweight, or less than 1500, 750, 300, 150, 75, 15, 7.5, 1.5, 0.75, 0.15, 0.075, 0.015, 0.0075, 0.0015, 0.00075, 0.00015 nmol of iRNA agent per kg of bodyweight. The unit dose, for example, can be administered by injection (e.g., intravenous or intramuscular, intrathecally, or directly into an organ), an inhaled dose, or a topical application.

The dosage can be an amount effective to treat or prevent a disease or disorder. It can be given prophylactically or as the primary or a part of a treatment protocol.

In one embodiment, the unit dose is administered less frequently than once a day, e.g., less than every 2, 4, 8 or 30 days. In another embodiment, the unit dose is not administered with a frequency (e.g., not a regular frequency). For example, the unit dose may be administered a single time. Because iRNA agent mediated silencing can persist for several days after administering the iRNA agent composition, in many instances, it is possible to administer the composition with a frequency of less than once per day, or, for some instances, only once for the entire therapeutic regimen.

In one embodiment, a subject is administered an initial dose, and one or more maintenance doses of an iRNA agent, e.g., a double-stranded iRNA agent, or siRNA agent, (e.g., a precursor, e.g., a larger iRNA agent which can be processed into an siRNA agent, or a DNA which encodes an iRNA agent, e.g., a double-stranded iRNA agent, or siRNA agent, or precursor thereof). The maintenance dose or doses are generally lower than the initial dose, e.g., one-half less of the initial dose. A maintenance regimen can include treating the subject with a dose or doses ranging from 0.01 to 75 mg/kg of body weight per day, e.g., 70, 60, 50, 40, 30, 20, 10, 5, 2, 1, 0.5, 0.1, 0.05, 0.01, 0.005, 0.001, or 0.0005 mg per kg of body weight per day. The maintenance doses are preferably administered no more than once every 5, 10, or 30 days. Further, the treatment regimen may last for a period of time which will vary depending upon the nature of the particular disease, its severity and the overall condition of the patient. In preferred embodiments the dosage may be delivered no more than once per day, e.g., no more than once per 24, 36, 48, or more hours, e.g., no more than once every 5 or 8 days. Following treatment, the patient can be monitored for changes in his condition and for alleviation of the symptoms of the disease state. The dosage of the compound may either be increased in the event the patient does not respond significantly to current dosage levels, or the dose may be decreased if an alleviation of the symptoms of the disease state is observed, if the disease state has been ablated, or if undesired side-effects are observed.

The effective dose can be administered in a single dose or in two or more doses, as desired or considered appropriate under the specific circumstances. If desired to facilitate repeated or frequent infusions, implantation of a delivery device, e.g., a pump, semi-permanent stent (e.g., intravenous, intraperitoneal, intracisternal or intracapsular), or reservoir may be advisable.

Following successful treatment, it may be desirable to have the patient undergo maintenance therapy to prevent the recurrence of the disease state, wherein the compound of the invention is administered in maintenance doses, ranging from 0.001 g to 100 g per kg of body weight (see U.S. Pat. No. 6,107,094).

The concentration of the iRNA agent composition is an amount sufficient to be effective in treating or preventing a disorder or to regulate a physiological condition in humans. The concentration or amount of iRNA agent administered will depend on the parameters determined for the agent and the method of administration, e.g. nasal, buccal, or pulmonary. For example, nasal formulations tend to require much lower concentrations of some ingredients in order to avoid irritation or burning of the nasal passages. It is sometimes desirable to dilute an oral formulation up to 10-100 times in order to provide a suitable nasal formulation.

Certain factors may influence the dosage required to effectively treat a subject, including but not limited to the severity of the disease or disorder, previous treatments, the general health and or age of the subject, and other diseases present. It will also be appreciated that the effective dosage of an iRNA agent such as an siRNA used for treatment may increase or decrease over the course of a particular treatment. Changes in dosage may result and become apparent from the results of diagnostic assays. For example, the subject can be monitored after administering an iRNA agent composition. Based on information from the monitoring, an additional amount of the iRNA agent composition can be administered.

Dosing is dependent on severity and responsiveness of the disease condition to be treated, with the course of treatment lasting from several days to several months, or until a cure is effected or a diminution of disease state is achieved. Optimal dosing schedules can be calculated from measurements of drug accumulation in the body of the patient. Persons of ordinary skill can easily determine optimum dosages, dosing methodologies and repetition rates. Optimum dosages may vary depending on the relative potency of individual compounds, and can generally be estimated based on EC50s found to be effective in in vitro and in vivo animal models as described above.

iRNA agents of the present invention as described herein may be useful in the treatment and (where appropriate) in the prevention of any one of the following diseases/disorders;

Cystic fibrosis, Liddles syndrome, renal insufficiency, hypertension, electrolyte imbalances.

In particular in some embodiments, iRNA agents of the invention may be used to treat and or prevent adverse clinical manifestations of these diseases/disorders.

The invention is further illustrated by the following examples, which should not be construed as further limiting.

EXAMPLES

Source of Reagents

Where the source of a reagent is not specifically given herein, such reagent may be obtained from any supplier of reagents for molecular biology at a quality/purity standard for application in molecular biology.

Example 1

Selection of Sequences

In order to identify therapeutic siRNAs to downmodulate expression of the alpha subunit of the epithelial sodium channel ENaC (α-ENaC), screening sets were defined based on a bioinformatic analysis. The key drivers for the design of the screening set were predicted specificity of the siRNAs against the transcriptome of the relevant species. For the identification of alpha-ENaC siRNAs and an efficient delivery system a three pronged approach was used: Rat was selected as the test species to address silencing efficacy in vivo after intratracheal delivery, guinea pig was selected as the disease model organism to demonstrate that alpha-ENaC mRNA reduction results in a measurable functional effect. The therapeutic siRNA molecule has to target human alpha-ENaC as well as the alpha-ENaC sequence of at least one toxicology-relevant species, in this case, rhesus monkey.

Initial analysis of the relevant alpha-ENaC mRNA sequence revealed few sequences can be identified that fulfil the specificity requirements and at the same time target alpha-ENaC mRNA in all relevant species. Therefore it was decided to design independent screening sets for the therapeutic siRNA and for the surrogate molecules to be tested in the relevant disease model (Tables 1A, 1B, 1C and 1D).

All siRNAs recognize the human alpha-ENaC sequence, as a human cell culture system was selected for determination of in vitro activity (H441, see below). Therefore all siRNAs can be used to target human alpha-ENaC mRNA in a therapeutic setting.

The therapeutic screening sets were designed to contain only siRNA sequences that are fully complementary to the human and rhesus monkey alpha-ENaC sequences.

Design and in Silico Selection of siRNAs Targeting alpha-ENaC (SCNN1A)

siRNA design was carried out to identify siRNAs for the four previously defined sets (see above):
a) "Initial screening set"
b) "Extended screening set"
c) "In vivo surrogate set for rat"
d) "In vivo surrogate set for guinea pig"

Initial Screening Set

The aim for in silico selection of an initial screening set was to identify siRNAs specifically targeting human alpha-ENaC, as well as its rhesus monkey ortholog. The human target mRNA (NM_001038.4) was downloaded from NCBI resource (http://www.ncbi.nlm.nih.gov/entrez/query.fcgi?CMD=search&DB=nucleotide) during the complete siRNA selection procedure. In order to identify the alpha-ENaC rhesus (Macaca mulatta) ortholog, the human sequence was used in a blastn search at Baylor College of Medicine (http://www.hgsc.bcm.tmc.edu/blast/?organism=Mmulatta) against Mmulatta contigs as of 2004 10 01. All hit regions were extracted and assembled by the CAP assembly tool to generate a first assembly sequence. Further, a BLAST search was performed with the human sequence at UCSC (http://genome.ucsc.edu/cgi-bin/hgBlat?command=start&org=Rhesus&db=rheMac2&hgsid=84859356) against Rhesus freeze 12 Mar. 2005. The scaffold hit 84554 was downloaded and used together with the first assembly sequence by CAP to generate the final consensus sequence for rhesus alpha-ENaC.

Following extraction of all overlapping 19mer sequences out of the human mRNA, conserved 19mers were identified that had identical sequences in the assembled rhesus consensus sequence. Those 19mer sequences were defined as the pool of human-rhesus cross-reactive siRNA (sense) sequences, represented by 1185 19mers.

The corresponding antisense sequences were generated and tested for specificity in human. For this, their predicted potential for interacting with irrelevant target mRNAs (off-target potential) was taken as parameter. Sequences with low off-target potential were defined as preferable and predicted to be more specific.

For further selection, candidate siRNAs were ranked according to their predicted potential for interacting with other host sequences (here, without limitation, human). siRNAs with low off-target potential are assumed to be more specific in vivo. For predicting siRNA-specific off-target potential, the following assumptions were made:

1) off-target potential of a strand can be deduced from the number and distribution of mismatches to an off-target
2) the most relevant off-target, that is the gene predicted to have the highest probability to be silenced due to tolerance of mismatches, determines the off-target potential of the strand
3) positions 2 to 9 (counting 5' to 3') of a strand (seed region) may contribute more to off-target potential than rest of sequence (that is non-seed and cleavage site region) (Haley, B., and Zamore, P. D., Nat Struct Mol. Biol. 2004, 11:599).
4) positions 10 and 11 (counting 5' to 3') of a strand (cleavage site region) may contribute more to off-target potential than non-seed region (that is positions 12 to 18, counting 5' to 3')
5) positions 1 and 19 of each strand are not relevant for off-target interactions
6) off-target potential can be expressed by the off-target score of the most relevant off-target, calculated based on number and position of mismatches of the strand to the most homologous region in the off-target gene considering assumptions 3 to 5
7) assuming potential abortion of sense strand activity by internal modifications introduced, only off-target potential of antisense strand will be relevant To identify potential off-target genes, 19mer antisense sequences were subjected to a homology search against publicly available human mRNA sequences, assumed to represent the human comprehensive transcriptome.

To this purpose, fastA (version 3.4) searches were performed with all 19mer sequences against a human RefSeq database (available version from ftp://ftp.ncbi.nih.gov/refseq/ on Nov. 18, 2005). FastA search was executed with parameters-values-pairs—f 30-g 30 in order to take into account the homology over the full length of the 19mer without any gaps. In addition, in order to ensure the listing of all relevant off-target hits in the fastA output file the parameter—E 15000 was used.

The search resulted in a list of potential off-targets for each input sequence listed by descending sequence homology over the complete 19mer.

To rank all potential off-targets according to assumptions 3 to 5, and by this identify the most relevant off-target gene and its off-target score, fastA output files were analyzed by a perl script.

The script extracted the following off-target properties for each 19mer input sequence and each off-target gene to calculate the off-target score:

Number of mismatches in non-seed region
Number of mismatches in seed region
Number of mismatches in cleavage site region
The off-target score was calculated by considering assumptions 3 to 5 as follows:

Off-target score=number of seed mismatches*10+
number of cleavage site mismatches*1.2+number of non-seed mismatches*1

The most relevant off-target gene for each 19mer sequence was defined as the gene with the lowest off-target score. Accordingly, the lowest off-target score was defined as representative for the off-target potential of each siRNA, represented by the 19mer antisense sequence analyzed.

Calculated off-target potential was used as sorting parameter (descending by off-target score) in order to generate a ranking for all human-rhesus cross-reactive siRNA sequences.

An off-target score of 3 or more was defined as prerequisite for siRNA selection, whereas all sequences containing 4 or more G's in a row (poly-G sequences) were excluded, leading to selection of a total of 152 siRNAs targeting human and rhesus ENaC alpha (see Table 1a).

Extended Screening Set

The aim for in silico selection of the extended screening set was to identify all further siRNAs targeting human alpha-ENaC with sufficient specificity, that were excluded from the initial set due to missing cross-reactivity to rhesus. The remaining sequences from the pool of 19mers derived from human alpha-ENaC that have not been analyzed before were taken and the corresponding antisense sequences were generated. The most relevant off-target gene and its corresponding off-target scores were calculated as described in section "Initial screening set".

For determining cross-reactivity to mouse and guinea pig (Cavia porcellus/cobya), alpha-ENaC sequences of these species were downloaded from NCBI nucleotide database 1 (accession numbers NM_011324.1 and AF071230 (full length)/DQ109811 (partial cds), respectively). The two guinea pig sequences were used to generate aguinea pig alpha-ENaC consensus sequence. Every human 19mer sequence was tested for presence in the mouse and guinea pig sequences. Positive sequences were assigned to the pool of human-mouse cross-reactive siRNA (sense) sequences, or human-guinea pig cross-reactive siRNA (sense) sequences. After exclusion of all poly-G sequences, sequences were selected with off-target scores of 3 or more as well as those with off-target scores of 2.2 or 2.4 and cross-reactivity to mouse, rhesus or guinea pig. The total number of siRNAs in the extended screening pool was 3 (see Table 1b).

In Vivo Rat Surrogate Set

The aim for in silico selection of the in vivo rat surrogate set was to identify all siRNAs targeting human and rat alpha-ENaC with sufficient specificity in rat. For identification of human-rat cross-reactive siRNAs, rat alpha-ENaC mRNA sequence was downloaded from NCBI nucleotide database (accession number, NM_031548.2), and all sequences out of the pool of human 19mers were tested for presence in the rat sequence, representing the pool of human-rat cross-reactive siRNA (sense) sequences.

The corresponding antisense sequences were generated and tested for specificity in rat. For this, the most relevant off-target gene in rat and its corresponding off-target scores were calculated as described in section "Initial screening set" using the rat mRNA set (RefSeq database) instead of the human transcripts. After exclusion of all poly-G sequences, a ranking was generated considering the rat off-target score in first priority and the human off-target score with second priority. Those 48 sequences from the top of the list were finally selected representing the in vivo rat surrogate set (see Table 1c).

In Vivo Guinea Pig Surrogate Set

The aim for in silico selection of the in vivo guinea pig surrogate set was to identify all siRNAs targeting human and guinea pig alpha-ENaC that have not been selected in previous sets. The remaining siRNAs of the previously determined set of human-guinea pig cross-reactive siRNA (sense) sequences were ranked according to human off-target scores. The top 63 sequences (excluding poly-G sequences) were selected, representing the in vivo guinea pig surrogate set (see Table 1d).

Example 2 siRNA Synthesis

Synthesis of Nucleotides Comprising Natural Bases

As the siRNAs from the screening sets are all potentially intended for in vivo administration, siRNAs were synthesised with a modification strategy that protects the siRNAs from degradation by endo- and exonucleases in a biological environment. In this strategy, the 3'-ends of both strands are protected from a 3'->5'-exonucleotitic activity by a phosphorothioate linkage between the two last nucleobases at the 3'-end. In order to inhibit endo-nucleolytic degradation of the siRNA all pyrimidines in the sense strand of the siRNA were replaced with the corresponding 2'-O-methyl-modified ribonucleotide. To reduce the number of modifications in the antisense strand, which is the more active strand and therefore more sensitive to modifications, we only modified the pyrimidines in the context of previously identified major nuclease cleavage sites with 2'-O-methyl groups. The major cleavage sites are the following two sequence motifs: 5'-UA-3' and 5'-CA-3'.

Since it has also been considered to use siRNAs in formulations that potentially protect the RNAs from the nucleolytic biological environment in the lung, the same set of siRNAs were also synthesized without any protection from endonucleolytic degradation.

Where the source of a reagent is not specifically given herein, such reagent may be obtained from any supplier of reagents for molecular biology at a quality/purity standard for application in molecular biology.

Single-stranded RNAs were produced by solid phase synthesis on a scale of 1 μmole using an Expedite 8909 synthesizer (Applied Biosystems, Applera Deutschland GmbH, Darmstadt, Germany) and controlled pore glass (CPG, 500 Å, Proligo Biochemie GmbH, Hamburg, Germany) as solid support. RNA and RNA containing 2'-O-methyl nucleotides were generated by solid phase synthesis employing the corresponding phosphoramidites and 2'-O-methyl phosphoramidites, respectively (Proligo Biochemie GmbH, Hamburg, Germany). These building blocks were incorporated at selected sites within the sequence of the oligoribonucleotide chain using standard nucleoside phosphoramidite chemistry such as described in Current protocols in nucleic acid chemistry, Beaucage, S. L. et al. (Edrs.), John Wiley & Sons, Inc., New York, N.Y., USA. Phosphorothioate linkages were introduced by replacement of the iodine oxidizer solution with a solution of the Beaucage reagent (Chruachem Ltd, Glasgow, UK) in acetonitrile (1%). Further ancillary reagents were obtained from Mallinckrodt Baker (Griesheim Germany).

Deprotection and purification of the crude oligoribonucleotides by anion exchange HPLC were carried out according to established procedures. Yields and concentrations were determined by UV absorption of a solution of the respective RNA at a wavelength of 260 nm using a spectral photometer (DU 640B, Beckman Coulter GmbH, Unterschleißheim, Germany). Double stranded RNA was generated by mixing an equimolar solution of complementary strands in annealing buffer (20 mM sodium phosphate, pH 6.8; 100 mM sodium chloride), heated in a water bath at 85-90° C. for 3 minutes and cooled to room temperature over a period of 3-4 hours. The annealed RNA solution was diluted to a concentration of 50 μmole double stranded RNA/L and stored at −20° C. until use.

Example 3 siRNA Testing In Vitro

The ability of the iRNA agents to inhibit expression of alpha-ENaC was tested in human cell lines in vitro, or in rats in vivo. The iRNA agent is transfected into the cells, e.g., by transfection, allowed to act on the cells for a certain time, e.g., 24 hours, and levels of alpha-ENaC mRNA were determined by branched-DNA analysis. Alternatively, the iRNA agent is administered in vivo via the intratracheal route and the inhibition of alpha-ENaC mRNA expression determined by branched-DNA analysis on the target organ. Complementing these direct assays, we tested the inhibition of target gene expression by RNAi agents for alpha-ENaC mRNA recombinantly expressed in mammalian host cells.

Cell Lines

H441 cells were obtained from the American Type Culture Collection (ATCC-Number: HTB-174, LCG Promochem GmbH, Wesel, Germany) and were grown in RPMI 1640, 10% fetal calf serum 100 u penicillin/100 μg/mL streptomycin, 2 mM L-glutamine, 10 nM Hepes and 1 mM Sodium-Pyruvate (all from Biochrom AG, Berlin, Germany) at 37° C. under a 5% $CO_2$/95% air atmosphere.

Primary human bronchial epithelial cells were obtained from Cambrex (Cat # CC-2540) and were routinely grown in BEGM media with singlequots (Cambrex Cat # CC-3170 minus tri-iodothreonine). For polarisation and growth at air liquid interface the cells were grown in a 1:1 mixture of BFGM:DMEM supplemented with 4.5 g/L D-Glucose (Gibco BRL Cat # 41965-039) and supplemented with singlequots (Cambrex Cat # CC-4175), as above but minus the tri-iodothreonine and GA1000 aliquots and in the presence of 50 μg/mL Gentamycin (Gibco Brl Cat # 10131-015). As cells were maintained in serum-free media, trypsin neutralisation solution was used during passaging steps (Cambrex Cat # CC-5002). For polarisation and culture at air-liquid interface the cells were grown on semipermeable (0.4 micron) polycarbonate supports (Corning Costar Cat # 3407 #3460) and cultured throughout at 37° C. under a 5% $CO_2$/95% air atmosphere.

Cos-1 African green monkey kidney cells (ATCC #CRL-1650) were grown in Dulbecco's MEM, 4.5 g/L glucose, 10% fetal bovine serum, 2 mM L-glutamine, 1.5 g/L sodium bicarbonate (Gibco BRL), 100 u penicillin/100 μg/mL streptomycin.

Example 3.1

In Vitro Screen for Active alpha-ENaC siRNAs and IC50 Determination in H441

One day prior to transfection, ENaC-alpha expression was induced in H441 cells (ATCC-Number: HTB-174, LCG Promochem GmbH, Wesel, Germany) by adding 100 nM of dexamthasone. Directly before transfection, cells were seeded at $1.5 \times 10^4$ cells/well on 96-well plates (Greiner Bio-One GmbH, Frickenhausen, Germany) in 75 μL of growth medium (RPMI 1640, 10% fetal calf serum, 100 u penicillin/100 μl/ml streptomycin, 2 mM L-glutamine, 10 nM Hepes and 1 mM Sodium-Pyruvate, all from Biochrom AG, Berlin, Germany). Transfections were performed in quadruplicates. For each well 0.5 μL Lipofectamine2000 (Invitrogen GmbH, Karlsruhe, Germany) were mixed with 12 μL Opti-MEM (Invitrogen) and incubated for 15 min at room temperature. For the siRNA concentration being 50 nM in the 100 μL transfection volume, 1 μL of a 5 μM siRNA were mixed with 11.5 μL Opti-MEM per well, combined with the Lipofectamine2000-Opti-MEM mixture and again incubated for 15 minutes at room temperature. siRNA-Lipofectamine2000-complexes were applied completely (25 μL each per well) to the cells and cells were incubated for 24 h at 37° C. and 5% $CO_2$ in a humidified incubator (Heraeus GmbH, Hanau).

Cells were harvested by applying 50 μL of lysis mixture (content of the QuantiGene bDNA-kit from Genospectra, Fremont, USA) to each well containing 100 μL of growth medium and were lysed at 53° C. for 30 min. Afterwards, 50 μL of the lysates were incubated with probesets specific to human ENaC-alpha and human GAPDH (sequence of probesets see below) and proceeded according to the manufacturer's protocol for QuantiGene. In the end chemoluminescence was measured in a Victor2-Light (Perkin Elmer, Wiesbaden, Germany) as RLUs (relative light units) and values obtained with the hENaC probeset were normalized to the respective GAPDH values for each well. Values obtained with siRNAs directed against ENaC-alpha were related to the value obtained with an unspecific siRNA (directed against HCV) which was set to 100%. The percentage residual expression of alpha-ENaC for siRNA examples is shown in Tables 1A-1D.

Effective siRNAs from the screen were further characterized by dose response curves. Transfections of dose response curves were performed at the following concentrations: 100 mM, 16.7 nM, 2.8 nM, 0.46 nM, 77 picoM, 12.8 picoM, 2.1 picoM, 0.35 picoM, 59.5 fM, 9.9 fM and mock (no siRNA) and diluted with Opti-MEM to a final concentration of 12.5 µl according to the above protocol. Data analysis was performed using Microsoft Excel add-in software XL-fit 4.2 (IDBS, Guildford, Surrey, UK) and applying the sigmoidal model number 606.

| FPL Name | Members | Function | Sequence | SEQ. ID.NO: |
|---|---|---|---|---|
| Probesets: human alpha-ENaC: | | | | |
| hENAC001.235.255.CE | | CE | gtctgtccagggtttccttccTTTTTctcttggaaagaaagt | 1645 |
| hENAC002.274.293.CE | | CE | actgccattcttggtgcagtTTTTTctcttggaaagaaagt | 1646 |
| hENAC003.344.367.CE | | CE | ctctcctggaagcaggagtgaataTTTTTctcttggaaagaaagt | 1647 |
| hENAC004.391.411.CE | | CE | gccgcggatagaagatgtaggTTTTTctcttggaaagaaagt | 1648 |
| hENAC005.501.521.CE | | CE | gcacttggtgaaacagcccagTTTTTctcttggaaagaaagt | 1649 |
| hENAC006.539.560.CE | | CE | agcagagagctggtagctggtcTTTTTctcttggaaagaaagt | 1650 |
| hENAC007.256.273.LE | | LE | cgccataatcgcccccaaTTTTTaggcataggacccgtgtct | 1651 |
| hENAC008.368.390.LE | | LE | cacagccacactccttgatcatgTTTTTaggcataggacccgtgtct | 1652 |
| hENAC009.412.431.LE | | LE | ggagcttatagtagcagtaccccTTTTTaggcataggacccgtgtct | 1653 |
| hENAC010.455.477.LE | | LE | ggagcttatagtagcagtaccccTTTTTaggcataggacccgtgtct | 1654 |
| hENAC011.522.538.LE | | LE | acgctgcatggcttccgTTTTTaggcataggacccgtgtct | 1655 |
| hENAC012.561.580.LE | | LE | gagggccatcgtgagtaaccTTTTTaggcataggacccgtgtct | 1656 |
| hENAC013.214.234.BL | | BL | Tcatgctgatggaggtctcca | 1657 |
| hENAC014.294.318.BL | | BL | Ggtaaaggttctcaacaggaacatc | 1658 |
| hENAC015.319.343.BL | | BL | Cacacctgctgtgtgtactttgaag | 1659 |
| hENAC016.432.454.BL | | BL | Caggaactgtgctttctgtagtc | 1660 |
| hENAC017.478.500.BL | | BL | Gtggtctgaggagaagtcaacct | 1661 |
| hENAC018.581.599.BL | | BL | Ccattcctgggatgtcacc | 1662 |
| human GAPDH: | | | | |
| hGAP001 | AG261085. 252.271.CE | CE | gaatttgccatgggtggaatTTTTTctcttggaaagaaagt | 1663 |
| hGAP002 | AF261085. 333.352.CE | CE | ggagggatctcgctcctggaTTTTTctcttggaaagaaagt | 1664 |
| hGAP003 | AF261085. 413.431.CE | CE | ccccagccttctccatggtTTTTTctcttggaaagaaagt | 1665 |
| hGAP004 | AF261085. 432.450.CE | CE | gctccccctgcaaatgagTTTTTctcttggaaagaaagt | 1666 |
| hGAP005 | AF261085. 272.289.LE | LE | agccttgacggtgccatgTTTTTaggcataggacccgtgtct | 1667 |
| hGAP006 | AF261085. 290.310.LE | LE | gatgacaagcttcccgttctcTTTTTaggcataggacccgtgtct | 1668 |
| hGAP007 | AF261085. 311.332.LE | LE | agatggtgatgggatttccattTTTTTaggcataggacccgtgtct | 1669 |
| hGAP008 | AF261085. 353.372.LE | LE | gcatcgccccacttgattttTTTTTaggcataggacccgtgtct | 1670 |
| hGAP009 | AF261085. 373.391.LE | LE | cacgacgtactcagcgccaTTTTTaggcataggacccgtgtct | 1671 |

-continued

| FPL Name | Members | Function | Sequence | SEQ. ID.NO: |
|---|---|---|---|---|
| hGAP010 | AF261085. 451.472.LE | LE | ggcagagatgatgaccctttttgTTTTTaggcataggacccgtgtct | 1672 |
| hGAP011 | AF261085. 392.412.BL | BL | Ggtgaagacgccagtggactc | 1673 |

The $IC_{50}$s for siRNA examples is shown in Table 2A and 2B.

Example 3.2

Transient alpha-ENaC Knockdown in a Primary Human Bronchial Epithelial Model Human bronchial epithelial cells (donor reference 4F1499) were plated in 24-well plates at $1\times10^5$ cells per well in 0.5 mL growth medium one day before transfection. The cells were 70% confluent on the day of siRNA transfection.

Each siRNA was resuspended at 100 nM in 1 mL of Optimem I (Invitrogen) and in a separate tube, Lipofectamine 2000 (Invitrogen) was diluted to 6 µL/mL in Optimem, giving an amount sufficient for transfection of four replicates in a 24-well plate. After 5 minutes at room temperature, the mixtures were combined to give the desired final concentration of 50 nM siRNA and 3 µL/mL Lipofectamine 2000. The transfection mixture was incubated for a further 20 minutes at room temperature and 420 µL of the siRNA/reagent complex was added to each well as dictated by the experimental design. Plates were gently rocked to ensure complete mixing and then incubated at 37° C. in an incubator at 5% $CO_2$/95% air for 4 hours. Subsequently, the transfection mixture was aspirated and the cells were returned to normal culture conditions for a further 20 hours.

Cell lysates were prepared for branched-DNA analysis. A 2:1 medium:lysis buffer (Panomics) mixture was prepared and cells were lysed in 200 µL at 53° C. for 30 minutes. After a visual check for complete lysis, the cell lysates were stored at –80° C. for subsequent analysis. Branched-DNA analysis was performed as described above, with alpha-ENaC expression normalized against GAPDH. The branched DNA analysis protocol used differs from that above only in that 20 µL of sample was applied to each well in this case.

Table 2C shows the alpha-ENaC expression in primary HBEC for siRNA examples.

Example 3.3

In Vitro Inhibition of Exogenously Expressed Cloned Cynomolgous alpha-ENaC Gene Expression for Selected RNAi Agents in Cos-1 Cells Cloning of the Cynomolgous alpha-ENaC Sequence Primer sequences for amplification of 5'-UTR and CDS (nucleotides shown in brackets correspond to the *Mocaca mulatta* (Rhesus monkey) α-ENaC cDNA sequence):

(SEQ.I.D.NO:1674)
P745: 5'-CTCCATGTTCTGCGGCCGCGGATAGAAG-3' (nt 1427)

(SEQ.I.D.NO:1675)
P733: 5'-CCGGCCGGCGGGCGGGCT-3' (nt 1)

(SEQ.I.D.NO:1676)
P734: 5'-CTCCCCAGCCCGGCCGCT-3' (nt 17)

(SEQ.I.D.NO:1677)
P735: 5'-GGCCGCTGCACCTGTAGGG-3' (nt 28)

Primer sequences for amplification of CDS and 3'-UTR:

(SEQ.I.D.NO:1678)
P737: 5'-ATGGAGTACTGTGACTACAGG-3' (nt 1422)

(SEQ.I.D.NO:1679)
P740: 5'-TTGAGCATCTGCCTACTTG-3' (nt 3113)

Primer sequences for amplification of internal part of CDS:

(SEQ.I.D.NO:1679)
P713: 5'-5'-ATGGATGATGGTGGCTTTAACTTGCGG-3' (nt 1182)

(SEQ.I.D.NO:1680)
P715: 5'-5'-TCAGGGCCCCCCCAGAGG-3' (nt 2108)

Cynomolgus (*Macaca fascicularis*) lung total RNA (#R1534152-Cy-BC) was purchased from BioCat (Germany). Synthesis of cDNA was performed using the SuperScript III First Strand Synthesis System (Invitrogen). Synthesis of cDNA was performed using either random hexamers or oligo dT primers. In addition, cynomolgus lung first strand cDNA was also purchased from BioCat/#C1534160-Cy-BC). For PCR amplification, the Advantage 2 PCR kit (#K1910-1, Clontech) was used. Amplification of the 5'-UTR and parts of the CDS was performed using P745 and a equimolar mixture of P733, P734 and P735. For PCR amplification of the CDS and 3'-UTR, primers P737 and P740 were used. The primers P713 and P715 were used for amplification of parts of the CDS.

All PCR products were analysed by agarose gel electrophoresis and then cloned into the pCR2.1 vector using the TOPO TA cloning kit (Invitrogen) in TOP10 bacteria. Clones were then picked and DNA was isolated using the Qiagen Miniprep kit. After restriction enzyme digest with EcoRI and analysis by agarose gel electrophoresis, DNA from correct clones were subjected to sequencing.

The sequences were then aligned with the α-ENaC cDNA sequence of Rhesus monkey, and sequences of the individual clones were aligned with each other. The full-length cynomolgus alpha-ENaC cDNA was then cloned by digestion of the 5'-part (5'-UTR and CDS, clone 55) with EcoR I and Not I, digestion of the middle part of the CDS by Not I and BstE II (clone 15), and the 3'-part (CDS and 3'-UTR) by BstE II and EcoR V(clone 80). The digested DNA fragments were then subcloned into pcDNA3.1, digested with EcoR I and EcoR V. The full-length cynomolgus alpha-ENaC cDNA in pcDNA3.1 was then subjected to full-length sequencing (Ingenetix, Vienna, Austria). The cynomolgus alpha-ENaC cDNA sequence corresponds to nt 28-3113 of the Rhesus alpha-ENaC cDNA sequence. Finally the cynomolgus alpha-ENaC cDNA was then excised from pcDNA3.1-cynomolgus alpha-ENaC by digestion with BamHI and EcoR V and subcloned into the vector pXOON. The plasmid map is illustrated in FIG. 1. Table 3B and Table 3A, respectively depict the protein (SEQ. I.D. NO: 1681) and DNA (SEQ. I.D. NO: 1682) sequence of cynomolgous alpha-ENaC.

Transfections:

COS-1 cells were seeded at 6×10⁴ cells/well on 24 well plates each in 0.5 mL of growth medium. One day after seeding the cells were co-transfected with the pXOON cynomolgous alpha-ENaC expression plasmid and the indicated siRNA. For each well, 4 ng of alpha-ENaC expression plasmid and 600 ng carrier plasmid (pNFAT-luc) were co-transfected with the relevant siRNA (final concentration 45 nM) using X-treme gene transfection reagent (Roche) at 3.75 µL/well in a total volume of 720 µL/well Opti-MEM (Invitrogen) as described below.

Transfections were performed in triplicate for each sample. Plasmid siRNA mastermixes (each for 3.5 wells) were prepared as follows: 14 ng alpha-ENaC expression plasmid, 2.1 µg carrier plasmid and 112 pmoles of relevant siRNA in a total volume 210 µL (Opti-MEM). A lipid mastermix was prepared for the whole transfection (105 µL lipid plus 1575 µL Opti-MEM for eight triplicate transfection samples). Plasmid siRNA and lipid were mixed in equal volume to give a total volume of 420 µL transfection mix per triplicate sample (3.5×). Following a 20 minute incubation at room temperature, 120 µL of the relevant transfection mix was added to each well of cells in a final transfection volume of 720 µL (Opti-MEM). Cells were transfected for 24 hours at 37° C. and 5% $CO_2$ in a humidified incubator (Heraeus GmbH, Hanau, Germany) and harvested for branched-DNA analysis.

Cell lysates were prepared for branched DNA analysis. A 2:1 medium:lysis buffer (Panomics) mixture was prepared and cells were lysed in 200 µL at 53° C. for 30 minutes. After a visual check for complete lysis, the cell lysates were stored at −80° C. for subsequent analysis. Branched-DNA analysis was performed as described above, with cyno alpha-ENaC expression normalized against eGFP from the expression plasmid. The branched-DNA analysis protocol used differs from that above only in that 20 µL of sample was applied to each well in this case.

Probesets:

| FPL Name | Function | Sequence | SEQ.I.D.NO: |
|---|---|---|---|
| cynomolgous alpha-ENaC: | | | |
| cyENa001 | CE | cgccgtgggctgctgggTTTTTctcttggaaagaaagt | 1683 |
| cyENa002 | CE | ggtaggagcggtggaactcTTTTTctcttggaaagaaagt | 1684 |
| cyENa003 | CE | cagaagaactcgaagagctctcTTTTTctcttggaaagaaagt | 1685 |
| cyENa004 | CE | cccagaaggccgtcttcatTTTTTctcttggaaagaaagt | 1686 |
| cyENa005 | LE | ggtgcagagccagagcactgTTTTTctcttggaaagaaagt | 1687 |
| cyENa006 | LE | gtgccgcaggttctgggTTTTTaggcataggacccgtgtct | 1688 |
| cyENa007 | LE | gatcagggcctcctcctcTTTTTaggcataggacccgtgtct | 1689 |
| cyENa008 | LE | ccgtggatggtggtattgttgTTTTTaggcataggacccgtgtct | 1690 |
| cyENa009 | LE | gcggttgtgctgggagcTTTTTaggcataggacccgtgtct | 1691 |
| cyENa0010 | LE | ttgccagtacatcatgccaaaTTTTTaggcataggacccgtgtct | 1692 |
| cyENa0011 | BL | acaccaggcggatggcg | 1693 |
| eGFP: | | | |
| EGFP001 | CE | ggcacgggcagcttgcTTTTTctcttggaaagaaagt | 1694 |
| EGFP002 | CE | ggtagcggctgaagcactgTTTTTctcttggaaagaaagt | 1695 |
| EGFP003 | CE | cctggacgtagccttcgggTTTTTctcttggaaagaaagt | 1696 |
| EGFP004 | CE | ccttgaagaagatggtgcgctTTTTTctcttggaaagaaagt | 1697 |
| EGFP005 | LE | cgaacttcacctcggcgcTTTTTctcttggaaagaaagt | 1698 |
| EGFP006 | LE | ccttcagctcgatgcggtTTTTTctcttggaaagaaagt | 1699 |
| EGFP007 | LE | gtcacgagggtgggccagTTTTTaggcataggacccgtgtct | 1700 |
| EGFP008 | LE | cacgccgtaggtcagggtgTTTTTaggcataggacccgtgtct | 1701 |

-continued

Probesets:

| FPL Name | Function | Sequence | SEQ.I.D.NO: |
|---|---|---|---|
| EGFP009 | LE | gtgctgcttcatgtggtcggTTTTTaggcataggacccgtgtct | 1702 |
| EGFP0010 | LE | tcaccagggtgtcgccctTTTTTaggcataggacccgtgtct | 1703 |
| EGFP0011 | BL | cggtggtgcagatgaacttca | 1704 |
| EGFP0012 | BL | catggcggacttgaagaagtc | 1705 |
| EGFP0013 | BL | cgtcctccttgaagtcgatgc | 1706 |

Table 2C shows the alpha-ENaC expression in cynomologous species for siRNA examples.

Example 3.4

Screening for Interferon-α Induction

To evaluate the ability of siRNA to stimulate interferon-α (IFNα) release, siRNA was incubated with freshly purified peripheral blood mononuclear cells (PBMCs) in vitro for 24 hours. The siRNA was added either directly to PBMCs, or first complexed with a lipid transfection agent (GenePorter 2 or Lipofectamine 2000 or DOTAP transfection agent) and subsequently incubated with PBMCs. As positive controls for IFNα induction, unmodified control sequences DI_A_2216 and DI_A_5167 were included.

DI_A_2216: is a single-stranded antisense DNA molecule (SEQ.I.D.NO:1707)
5'-dGsdGsdGdGdGdAdCdGdAdTdCdGdTdCdGsdGsdGsdGsdGsd
G-3'

DI_A_5167 is a cholesterol-conjugated siRNA

5'-GUCAUCACACUGAAUACCAAU-s- (SEQ.I.D.NO:xxxx)
chol-3'

3'-CsAsCAGUAGUGUGACUUAUGGUUA-5' (SEQ.I.D.NO:1708)

After 24 hours, the IFNα was measured by ELISA. The basal IFNα level was determined for untreated cells and was always very close to a water-only control. The addition of transfection agent alone gave no or little increase of IFNα levels. Known stimulatory oligonucleotides were added to cells, either directly or in the presence of transfectant, and the expected increases of IFNα were observed. This setup allows to determine the stimulation of IFNα in human PBMC by siRNA (or other oligonucleotides).

Isolation of Human PBMCs: A concentrated fraction of leukocytes (buffy coat) was obtained from the Blood Bank Suhl, Institute for Transfusion Medicine, Germany. These cells were negative for a variety of pathogens, including HIV, HCV, and others. The buffy coat was diluted 1:1 with PBS, added to a tube containing Ficoll, and centrifuged for 20 minutes at 2200 rpm to allow fractionation. This was followed by removal of the turbid layer of white blood cells and transferred to a tube with fresh PBS and Ficoll, which was centrifuged for 15 minutes at 2200 rpm. The turbid layer of white blood cells was again removed, transferred to RPMI 1640 culture medium and centrifuged for 5 minutes at 1,200 rpm to pellet the white blood cells. The cells were resuspended in RPMI, pelleted as above, and resuspended in media with 10% FCS to $1\times10^6$/mL.

Interferon-αMeasurement: Cells in culture were combined with either 500 nM (or 1 µM) oligonucleotide in Optimem or 133 nM oligonucleotide in GP2 or Lipofectamine2000 or DOTAP transfection agent for 24 hours at 37° C. Interferon-α was measured with Bender Med Systems (Vienna, Austria) instant ELISA kit according to the manufacturer's instructions.

Selection of lead therapeutic sequences was based on a level of IFNα induction of less than 15% of the positive control.

Example 3.5

Determination of siRNA Stability in Sputum of CF Patients

Sputum samples were collected by Dr. Ahmet Uluer, Children's Hospital Boston. After collection, sputum samples were treated with antibiotic and were UV-irradiated to reduce bacterial content. To determine siRNA stability in sputum samples, siRNAs were incubated in 30 µL sputum at a concentration of 5 µM at 37° C. for the indicated times. The reaction was terminated by addition of proteinase K and samples were incubated at 42° C. for another 20 minutes. A 40-mer RNA molecule made of L-nucleotides ("Spiegelmer") resistant to nuclease degradation was added and served as calibration standard. Samples were filtered through a 0.2 µm membrane to remove remaining debris. Samples were analyzed by denaturing ion exchange HPLC on a DNAPac PA 200 column (Dionex) at pH 11.0 using a gradient of sodium perchlorate for elution. siRNAs and degradation products were quantified by determination of the area under the peak for each sample. Concentration was normalized to the concentration in the un-incubated samples.

The selection of the lead therapeutic sequences (ND8356, ND8357 and ND8396) was based on an observed in vitro stability in CF sputum with a half-life greater than 60 minutes.

Example 3.6

Cross-checking of Lead Therapeutic Sequences against Known Polymorphisms in Human SCNN1A Gene To exclude known polymorphisms from the target sites of lead candidates, lead siRNA sequences were checked against the NCBI single nucleotide polymorphism (SNP) database (http://www.ncbi.nlm.nih.gov/entrez/query.fcgi?CMD=search&DB=snp). Of the 10 known exon polymorphisms in the human SCNN1A gene, none were shown to be present in the target sites of any of the 10 most potent lead therapeutic candidates.

Example 3.7

In Vitro Profiling of Top 5 Predicted Off-Target Sequences

A list of alignments for each sequence was sorted by homology over the 19-mer region. Off-targets were scored based on the number and position of the mismatches in accordance with the criteria described in example 1. The top 5 off-target sequences were identified for each lead therapeutic sequences (ND8356, ND8357 and ND8396). On- and off-target sequences were individually cloned into a dual luciferase reporter system (FIG. 2). Each cloned fragment encompassed the target 19 nucleotides in addition to 10 nucleotides flanking region, both 5' and 3' of the target sequence. The fragments were cloned into a multiple cloning site 3' to the *Renilla luciferase* sequence, under the control of an SV40 promoter. The activity of each siRNA against both on- and off-target sequences was determined by the relative fluorescence of the target *Renilla luciferase* to the Firefly luciferase, the latter being independently controlled by the HSV-TK promoter. Initially, transfections were performed in COS-7 cells at an siRNA concentration of 50 nM. Luciferase readouts were taken at 24 h post-transfection. At this high concentration of siRNA, no knockdown of greater than 30% was observed against any off-target sequence for any of the three lead siRNAs. Activity against the on-target sequence was demonstrated with a relative reduction in *Renilla luciferase* activity of approximately 80%. IC50 curves were also generated for each siRNA against the on-target sequence and controlled with the off-target sequences identified above. For each lead siRNA, on-target IC50's in this reporter assay were of similar order of magnitude (10-50 pM) to the IC50's obtained against the endogenous target in H441 (Example 3.3) indicating that for ND8356, ND8357 and ND8396, potency against the on-target sequence was at least 1000-5000 fold higher than for any of the predicted off-target sequences.

Example 3.8

Genotoxicity Profiling

Cytotoxicity determination: Cytotoxicity was determined by using a cell counter for the assessment of culture cell number.

It is well known that testing cytotoxic concentrations in vitro may induce genotoxic effects such as micronucleus formation. Therefore, we considered increased numbers of cells containing micronuclei appearing at cell counts of around 50% or less (compared to the concurrent negative control) to be cytotoxicity-related if no dose-dependent increase in micronucleated cells could already be observed at concentrations showing moderate toxicity at most. The analysis of a concentration showing at least 50% reduction in cell count is required by the guidelines regulating in vitro mammalian cell assays (OECD and ICH guidelines for the conduction of chromosome aberration testing). In addition, OECD protocols require testing of non-toxic compounds to include at least one precipitating concentration (as long as this doesn't exceed 10 mM or 5 mg/ml, whichever is lower). Since the in vitro micronucleus test aims to predict the outcome of the regulatory assays, i.e. in vitro chromosomal aberration test, the protocol for the in vitro micronucleus test was designed to meet the requirements for these tests.

Test system: TK6 cells are Ebstein-Barr-Virus transfected and immortalized cells (human lymphoblastoid origin derived from the spleen). Determination of the clastogenic and or aneugenic potential in the micronucleus test in vitro with TK6 cells with/without S9-liver homogenate (2%) from male rats (Aroclor 1254-pretreated). Treatment time: 20 hr (-S9), 3 hr (+S9). Sampling time: 24 hr after the start of 3-hour treatment, 48 hr after the start of 20-hour treatment. For each substance at least three concentrations (2 cultures per concentration) and 2000 cells per concentration were analyzed.

The micronucleus inducing effect for a tested concentration was considered positive if the frequency of micronucleated cells was >=2% and showed at least a doubling of the concurrent solvent control value, OR <2% and showed at least a 3-fold increase over the concurrent solvent control value To conclude an experiment to be positive, dose-effect relationship and cytotoxicity have to be taken into account.

Summary: Lead therapeutic sequences ND8396, ND8356, ND8357 neither induced increased numbers of cells containing micronuclei after 20-hour treatment without metabolic activation, nor after 3-hour treatment with or without S9. No cytotoxic concentration could be analyzed up to the testing limit of 5 mg/ml.

Example 3.9

In Vitro Functional Efficacy in H441: ND8396

In order to demonstrate in vitro functional efficacy of lead siRNA against alphaENaC H441 cells were transfected with siRNA and prepared for Ussings chamber analysis of ion transport. For transfection, H441 cells were plated into T25 flasks at $2\times10^6$ cells per flask in culture medium supplemented with 200 nM Dexamethasone. Cells in each flask were transfected with either ND8396 or a non targeting control siRNA at 30 nM siRNA and 4 mL/mL Lipofectamine 2000 in a total volume of 5 mL (serum free medium). One day after transfection, cells were plated onto 1 cm$^2$ Snapwell inserts at confluency ($2\times10^5$ cells per insert) to minimise the time required for differentiation and formation of tight junctions and supplied with medium in both the apical and the basolateral chambers. After one additional day of culture the apical medium was removed and the basolateral medium replaced, thus taking the cells to air-liquid interface (ALI) culture. Cells were maintained at ALI for a further six days prior to ion transport analysis.

For functional analysis in Ussings chambers, the Snapwell inserts were mounted in Vertical Diffusion Chambers (Costar) and were bathed with continuously gassed Ringer solution (5% $CO_2$ in %; pH 7.4) maintained at 37° C. containing: 120 mM NaCl, 25 mM $NaHCO_3$, 3.3 mM $KH_2PO_4$, 0.8 mM $K_2HPO_4$, 1.2 mM $CaCl_2$, 1.2 mM $MgCl_2$, and 10 mM glucose. The solution osmolarity was determined within the range of 280 and 300 mosmol $kgH_2O$. Cells were voltage clamped to 0 mV (model EVC4000; WPI). Transepithelial resistance ($R_T$) was measured by applying a 1 or 2-mV pulse at 30-s intervals, or using the initial potential difference across the cells and the initial current measured, and then calculating $R_T$ by Ohm's law. Data were recorded using a PowerLab workstation (ADInstruments). Following siRNA treatment the basal characteristics of the cells and the amiloride-sensitive short circuit current ($I_{SC}$ following application of 10 µM amiloride; apical side only) were recorded. ENaC channel activity in each culture was determined by the amiloride-sensitive $I_{SC}$ in each case.

Following assay, cells on the individual inserts were lysed for RNA analysis. A knockdown of 75% at the RNA level at the time of assay (ND8396 as compared to non-targeting control) was correlated with a functional knockdown of the amiloride sensitive current of approximately 30% (ND8396 as compared to non-targeting control).

Nucleic acid sequences are represented below using standard nomenclature, and specifically the abbreviations of Table A.

TABLE A

Abbreviations of nucleotide monomers used in nucleic acid sequence representation. It will be understood that these monomers, when present in an oligonucleotide, are mutually linked by 5'-3'-phosphodiester bonds.

| Abbreviation[a] | Nucleotide(s) |
|---|---|
| A | adenosine-5'-phosphate |
| C | cytidine-5'-phosphate |
| G | guanosine-5'-phosphate |
| T | 2'-deoxy-thymidine-5'-phosphate |
| U | uridine-5'-phosphate |
| c | 2'-O-methylcytidine-5'-phosphate |
| u | 2'-O-methyluridine-5'-phosphate |
| Ts | 2'-deoxy-thymidine-5'-phosphorothioate |

Table 1A: Selected siRNAs in initial screening set (human-rhesus ENaC alpha cross-reactive siRNAs). A total of 152 iRNA sequences were identified as an initial screening set, both with (sequence strands 1-304) and without (sequence strands 305-608) backbone modification. iRNA sequences were designed to be fully complementary to both the human and rhesus monkey alpha-ENaC sequences, according to the design criteria described in the examples section. The percentage residual expression of alpha-ENaC in two independent single-dose transfection experiments is shown (refer to examples section for methods used).

TABLE 1A

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND8285 | 1 | AGcccGuAGcGuGGccuccTsT | 2 | GGAGGCcACGCuACGGGCUTsT | 92% | 4% | 114% | 15% |
| ND8286 | 3 | ccGGGuAAuGGuGcAcGGGTsT | 4 | CCCGUGcACcAUuACCCGGTsT | 92% | 4% | 114% | 15% |
| ND8287 | 5 | AuGcuAucGcGAcAGAAcATsT | 6 | UGUUCUGUCGCGAuAGcAUTsT | 27% | 2% | 35% | 3% |
| ND8288 | 7 | uGcuAucGcGAcAGAAcAATsT | 8 | UUGUUCUGUCGCGAuAGcATsT | 23% | 1% | 32% | 4% |
| ND8289 | 9 | GcccGuuuAuGuAuGcuccTsT | 10 | GGAGcAuAcAuAAACGGGCTsT | 64% | 2% | 93% | 5% |
| ND8290 | 11 | GcccGuAGcGuGGccuccATsT | 12 | UGGAGGCcACGCuACGGGCTsT | 83% | 2% | 115% | 5% |
| ND8291 | 13 | ccGGAAAuuAAAGAGGAGcTsT | 14 | GCUCCUCUUuAAUUUCCGGTsT | 54% | 2% | 79% | 10% |
| ND8292 | 15 | ccGAAGGuuccGAAGccGATsT | 16 | UCGGCUUCGGAACCUUCGGTsT | 40% | 1% | 54% | 8% |
| ND8293 | 17 | GcAAuucGGccuGcuuuucTsT | 18 | GAAAAGcAGGCCGAAUUGCTsT | 41% | 2% | 51% | 4% |
| ND8294 | 19 | GGcGAAuuAcucucAcuucTsT | 20 | GAAGUGAGAGuAAUUCGCCTsT | 19% | 1% | 25% | 5% |
| ND8295 | 21 | GcGAAuuAcucucAcuccTsT | 22 | GGAAGUGAGAGuAAUUCGCTsT | 19% | 5% | 20% | 1% |
| ND8296 | 23 | AAccAGGcGAAuuAcucucTsT | 24 | GAGAGuAAUUCGCCUGGUUTsT | 92% | 4% | 115% | 19% |
| ND8297 | 25 | GGuAAuGGuGcAcGGGcAGTsT | 26 | CUGCCCGUGcACcAUuACCTsT | 79% | 2% | 104% | 14% |
| ND8298 | 27 | cucAcGAuGGcccucGGuGTsT | 28 | cACCGAGGGCcAUCGUGAGTsT | 61% | 3% | 97% | 14% |
| ND8299 | 29 | GcuccGAAGGuuccGAAGcTsT | 30 | GCUUCGGAACCUUCGGAGCTsT | 16% | 2% | 19% | 3% |
| ND8300 | 31 | GccGAuAcuGGucuccAGGTsT | 32 | CCUGGAGACcAGuAUCGGCTsT | 50% | 5% | 55% | 5% |
| ND8301 | 33 | ccGAuAcuGGucuccAGGcTsT | 34 | GCCUGGAGACcAGuAUCGGTsT | 53% | 2% | 65% | 6% |
| ND8302 | 35 | uGcuGuuGcAccAuAcuuuTsT | 36 | AAAGuAUGGUGcAAcAGcATsT | 19% | 1% | 25% | 3% |
| ND8303 | 37 | AAcGGucuGucccuGAuGcTsT | 38 | GcAUcAGGGAcAGACCGUUTsT | 90% | 3% | 96% | 11% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND8304 | 39 | uuAAcuuGcGGccuGGcGuTsT | 40 | ACGCcAGGCCGcAAGUuAATsT | 97% | 3% | 101% | 11% |
| ND8305 | 41 | GcuGGuuAcucAcGAuGGcTsT | 42 | GCcAUCGUGAGuAACcAGCTsT | 73% | 2% | 78% | 7% |
| ND8306 | 43 | uuAcucAcGAuGGcccucGTsT | 44 | CGAGGGCcAUCGUGAGuAATsT | 91% | 7% | 93% | 6% |
| ND8307 | 45 | GAAGuuGAuAcuGGucuccTsT | 46 | GGAGACcAGuAUCGGCUUCTsT | 71% | 3% | 73% | 6% |
| ND8308 | 47 | GAuAcuGGucuccAGGccGTsT | 48 | CGGCCUGGAGACcAGuAUCTsT | 86% | 1% | 90% | 9% |
| ND8309 | 49 | AuAcuGGucuccAGGccGATsT | 50 | UCGGCCUGGAGACcAGuAUTsT | 71% | 5% | 70% | 8% |
| ND8310 | 51 | cAAcGGucuGucccuGAuGTsT | 52 | cAUcAGGGAcAGACCGUUGTsT | 80% | 2% | 84% | 9% |
| ND8311 | 53 | uuuAAcuuGcGGccuGGcGTsT | 54 | CGCcAGGCCGcAAGUuAAATsT | 95% | 2% | 107% | 15% |
| ND8312 | 55 | uAcucAcGAuGGcccucGGTsT | 56 | CCGAGGGCcAUCGUGAGuATsT | 44% | 2% | 97% | 9% |
| ND8313 | 57 | uuucGGAGAGuAcuucAGcTsT | 58 | GCUGAAGuACUCUCCGAAATsT | 14% | 2% | 16% | 2% |
| ND8314 | 59 | GcAGAcGcucuuuGAccuGTsT | 60 | cAGGUcAAAGAGCGUCUGCTsT | 55% | 4% | 58% | 5% |
| ND8315 | 61 | cuAcAucuucuAuccGcGGTsT | 62 | CCGCGGAuAAGAAGAUGuAGTsT | 20% | 3% | 26% | 4% |
| ND8316 | 63 | AGGcGAAuuAcucucAcuuTsT | 64 | AAGUGAGAGuAAUUCGCCUTsT | 24% | 1% | 25% | 2% |
| ND8317 | 65 | ccGcuucAAccAGGucuccTsT | 66 | GGAGACCUGGUUGAAGCGGTsT | 62% | 5% | 64% | 4% |
| ND8318 | 67 | cAAccGcAuGAAGAcGGccTsT | 68 | GGCCGUCUUcAUGCGGUUGTsT | 54% | 6% | 54% | 4% |
| ND8319 | 69 | AuGAAGAcGGccuucuGGGTsT | 69 | CCcAGAAGGCCGUCUUcAUTsT | 44% | 4% | 44% | 6% |
| ND8320 | 71 | AGcAcAAccGcAuGAAGAcTsT | 72 | GUCUUcAUGCGGUUGUGCUTsT | 15% | 1% | 16% | 1% |
| ND8321 | 73 | ucGAGuuccAccGcuccuATsT | 74 | uAGGAGCGGUGGAACUCGATsT | 85% | 5% | 89% | 13% |
| ND8322 | 75 | cuGcuucuAccAGAcAuAcTsT | 76 | GuAUGUCUGGuAGAAGcAGTsT | 46% | 4% | 44% | 3% |
| ND8323 | 77 | GAGGGAGuGGuAccGcuucTsT | 78 | GAAGCGGuAccACUCCCUCTsT | 60% | 7% | 56% | 3% |
| ND8324 | 79 | ccuuuAuGGAuGAuGGuGGTsT | 80 | CcACcAUcAUCcAuAAAGGTsT | 83% | 9% | 82% | 1% |
| ND8325 | 81 | uGAGGGAGuGGuAccGcuuTsT | 82 | AAGCGGuAccACUCCCUcATsT | 77% | 6% | 72% | 2% |
| ND8326 | 83 | ccuGcAAccAGGcGAAuuATsT | 84 | uAAUUCGCCUGGUUGcAGGTsT | 41% | 4% | 44% | 7% |
| ND8327 | 85 | GGccuGGcGuGGAGAccucTsT | 86 | GAGGUCUCcACGCcAGGCCTsT | 101% | 5% | 95% | 4% |
| ND8328 | 87 | uGcuuuucGGAGAGuAcuuTsT | 88 | AAGuACUCUCCGAAAAGcATsT | 36% | 1% | 51% | 2% |
| ND8329 | 89 | cccGuAGcGuGGccuccAGTsT | 90 | CUGGAGGCcACGCuACGGGTsT | 52% | 1% | 51% | 2% |
| ND8330 | 91 | ccGuAGcGuGGccuccAGcTsT | 92 | GCUGGAGGCcACGCuACGGTsT | 86% | 9% | 84% | 3% |
| ND8331 | 93 | ccAGGcGAAuuAcucucAcTsT | 94 | GUGAGAGuAAUUCGCCUGGTsT | 15% | 2% | 13% | 1% |
| ND8332 | 95 | GAAAcuGcuAuAcuuucAATsT | 96 | UUGAAAGuAuAGcAGUUUCTsT | 10% | 1% | 10% | 1% |
| ND8333 | 97 | GcccGGGuAAuGGuGcAcGTsT | 98 | CGUGcACcAUuACCCGGGCTsT | 83% | 6% | 82% | 4% |
| ND8334 | 99 | cccGGGuAAuGGuGcAcGGTsT | 100 | CCGUGcACcAUuACCCGGGTsT | 56% | 4% | 71% | 10% |
| ND8335 | 101 | cGGGuAAuGGuGcAcGGGcTsT | 102 | GCCCGUGcACcAUuACCCGTsT | 42% | 3% | 91% | 8% |
| ND8336 | 103 | GGGuAAuGGuGcAcGGGcATsT | 104 | UGCCCGUGcACcAUuACCCTsT | 65% | 5% | 71% | 7% |
| ND8337 | 105 | uAAuGGuGcAcGGGcAGGATsT | 106 | UCCUGCCCGUGcACcAUuATsT | 46% | 3% | 46% | 4% |
| ND8338 | 107 | cuGGuuAcucAcGAuGGccTsT | 108 | GGCcAUCGUGAGuAACcAGTsT | 74% | 5% | 79% | 10% |
| ND8339 | 109 | GuuAcucAcGAuGGcccucTsT | 110 | GAGGGCcAUCGUGAGuAACTsT | 85% | 6% | 92% | 8% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND8340 | 111 | uGucAcGAuGGucAcccucTsT | 112 | GAGGGUGACcAUCGUGAcATsT | 85% | 4% | 74% | 5% |
| ND8341 | 113 | uGcuccGAAGGuuccGAAGTsT | 114 | CUUCGGAACCUUCGGAGcATsT | 37% | 2% | 32% | 3% |
| ND8342 | 115 | uccGAAGGuuccGAAGccGTsT | 116 | CGGCUUCGGAACCUUCGGATsT | 60% | 4% | 47% | 5% |
| ND8343 | 117 | uuccGAAGccGAuAcuGGTsT | 118 | ACcAGuAUCGGCUUCGGAATsT | 15% | 1% | 13% | 2% |
| ND8344 | 119 | AGccGAuAcuGGucuccAGTsT | 120 | CUGGAGACcAGuAUCGGCUTsT | 49% | 3% | 41% | 3% |
| ND8345 | 121 | cuuGGuAcuGccucuGAAcTsT | 122 | GUUcAGAGGcAGuACcAAGTsT | 55% | 2% | 47% | 4% |
| ND8346 | 123 | cucccGuAGcAcAcuAuAATsT | 124 | UuAuAGUGUGCuACGGGAGTsT | 67% | 3% | 57% | 5% |
| ND8347 | 125 | ucccGuAGcAcAcuAuAAcTsT | 126 | GUuAuAGUGUGCuACGGGATsT | 29% | 1% | 26% | 3% |
| ND8348 | 127 | uGcAccAuAcuuucuuGuATsT | 128 | uAcAAGAAAGuAUGGUGcATsT | 17% | 1% | 15% | 3% |
| ND8349 | 129 | uuGcccGuuuAuGuAuGcuTsT | 130 | AGcAuAcAuAAACGGGcAATsT | 68% | 2% | 50% | 4% |
| ND8350 | 131 | uGcccGuuuAuGuAuGcucTsT | 132 | GAGcAuAcAuAAACGGGcATsT | 59% | 8% | 44% | 6% |
| ND8351 | 133 | GGAcccuAGAccucuGcAGTsT | 134 | CUGcAGAGGUCuAGGGUCCTsT | 86% | 11% | 82% | 2% |
| ND8352 | 135 | ccuAGAccucuGcAGcccATsT | 136 | UGGGCUGcAGAGGUCuAGGTsT | 69% | 7% | 79% | 3% |
| ND8353 | 137 | uGGcAuGAuGuAcuGGcAATsT | 138 | UUGCcAGuAcAUcAUGCcATsT | 58% | 4% | 52% | 4% |
| ND8354 | 139 | uAcuGGcAAuucGGccuGcTsT | 140 | GcAGGCCGAAUUGCcAGuATsT | 101% | 4% | 100% | 4 |
| ND8355 | 141 | AAuucGGccuGcuuuucGGTsT | 142 | CCGAAAAGcAGGCCGAAUUTsT | 49% | 1% | 43% | 6% |
| ND8356 | 143 | cuGcuuuucGGAGAGuAcuTsT | 144 | AGuACUCUCCGAAAAGcAGTsT | 17% | 3% | 18% | 1% |
| ND8357 | 145 | uucGGAGAGuAcuucAGcuTsT | 146 | AGCUGAAGuACUCUCCGAATsT | 13% | 3% | 16% | 2% |
| ND8358 | 147 | AGcAGAcGcucuuuGAccuTsT | 148 | AGGUcAAAGAGCGUCUGCUTsT | 73% | 9% | 71% | 5% |
| ND8359 | 149 | cuuGcAGcGccuGAGGGucTsT | 150 | GACCCUcAGGCGCUGcAAGTsT | 57% | 9% | 64% | 7% |
| ND8360 | 151 | uGGcuuuAAcuuGcGGccuTsT | 152 | AGGCCGcAAGUuAAAGCcATsT | 102% | 5% | 82% | 8% |
| ND8361 | 153 | GcuuuAAcuuGcGGccuGGTsT | 154 | CcAGGCCGcAAGUuAAAGCTsT | 83% | 5% | 82% | 8% |
| ND8362 | 155 | uAAcuuGcGGccuGGcGuGTsT | 156 | cACGCcAGGCCGcAAGUuATsT | 119% | 3% | 13% | 2% |
| ND8363 | 157 | AccuuuAcccuucAAAGuATsT | 158 | uACUUUGAAGGGuAAAGGUTsT | 17% | 3% | 13% | 2% |
| ND8364 | 159 | GGuuAcucAcGAuGGcccuTsT | 160 | AGGGCcAUCGUGAGuAACCTsT | 104% | 9% | 117% | 17% |
| ND8365 | 161 | cAcGAuGGcccucGGuGAcTsT | 162 | GUcACCGAGGGCcAUCGUGTsT | 140% | 13% | 100% | 9% |
| ND8366 | 163 | AGAuGcuAucGcGAcAGAATsT | 164 | UUCUGUCGCGAuAGcAUCUTsT | 46% | 2% | 70% | 6% |
| ND8367 | 165 | AcGAuGGucAcccuccuGuTsT | 166 | AcAGGAGGGUGACcAUCGUTsT | 85% | 6% | 128% | 10% |
| ND8368 | 167 | cuccGAAGGuuccGAAGccTsT | 168 | GGCUUCGGAACCUUCGGAGTsT | 12% | 2% | 18% | 1% |
| ND8369 | 169 | AAGGuuccGAAGccGAuAcTsT | 170 | GuAUCGGCUUCGGAACCUUTsT | 63% | 7% | 114% | 19% |
| ND8370 | 171 | GGuAcuGccucuGAAcAcuTsT | 172 | AGUGUUcAGAGGcAGuACCTsT | 36% | 1% | 21% | 1% |
| ND8371 | 173 | AGcuuuGAcAAGGAAcuuuTsT | 174 | AAAGUUCCUUGUcAAAGCUTsT | 17% | 1% | 21% | 1% |
| ND8372 | 175 | uuuGAcAAGGAAcuuccuTsT | 176 | AGGAAAGUUCCUUGUcAAATsT | 16% | 2% | 26% | 4% |
| ND8373 | 177 | uGAcAAGGAAcuuccuAATsT | 178 | UuAGGAAAGUUCCUUGUcATsT | 12% | 1% | 22% | 5% |
| ND8374 | 179 | cccGuAGcAcAcuAuAAcATsT | 180 | UGUuAuAGUGUGCuACGGGTsT | 41% | 2% | 75% | 3% |
| ND8375 | 181 | cAcuAuAAcAcucGcuGGATsT | 182 | UCcAGcAGAUGUuAuAGUGTsT | 17% | 1% | 26% | 2% |
| ND8376 | 183 | uuGcuGuuGcAccAuAcuuTsT | 184 | AAGuAUGGUGcAAcAGcAATsT | 45% | 4% | 69% | 6% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND8377 | 185 | GuAcuGGcAAuucGGccuGTsT | 186 | cAGGCCGAAUUGCcAGuACTsT | 60% | 6% | 120% | 8% |
| ND8378 | 187 | uucGGccuGcuuuucGGAGTsT | 188 | CUCCGAAAAGcAGGCCGAATsT | 57% | 5% | 86% | 11% |
| ND8379 | 189 | ccuGcuuuucGGAGAGuAcTsT | 190 | GuACUCUCCGAAAAGcAGGTsT | 43% | 5% | 50% | 3% |
| ND8380 | 191 | GcuuuucGGAGAGuAcuucTsT | 192 | GAAGuACUCUCCGAAAAGCTsT | 16% | 2% | 24% | 2% |
| ND8381 | 193 | cuuuucGGAGAGuAcuucATsT | 194 | UGAAGuACUCUCCGAAAAGTsT | 12% | 1% | 16% | 3% |
| ND8382 | 195 | cAAccucAAcucGGAcAAGTsT | 196 | CUUGUCCGAGUUGAGGUUGTsT | 33% | 2% | 39% | 3% |
| ND8383 | 197 | cuAccAGAcAuAcucAucATsT | 198 | UGAUGAGuAUGUCUGGuAGTsT | 13% | 1% | 23% | 6% |
| ND8384 | 199 | cuGucGAGGcuGccAGAGATsT | 200 | UCUCUGGcAGCCUCGAcAGTsT | 11% | 1% | 18% | 3% |
| ND8385 | 201 | AAAcuGcuAuAcuuucAAuTsT | 202 | AUUGAAAGuAuAGcAGUUUTsT | 48% | 8% | 64% | 11% |
| ND8386 | 203 | GGcuuuAAcuuGcGGccuGTsT | 204 | cAGGCCGcAAGUuAAAGCCTsT | 55% | 7% | 70% | 8% |
| ND8387 | 205 | cuuuAAcuuGcGGccuGGcTsT | 206 | GCcAGGCCGcAAGUuAAAGTsT | 40% | 11% | 87% | 14% |
| ND8388 | 207 | AGGuGuGuAuucAcuccuGTsT | 208 | cAGGAGUGAAuAcAcACCUTsT | 45% | 3% | 41% | 5% |
| ND8389 | 209 | AcGAuGGcccucGGuGAcATsT | 210 | UGUcACCGAGGGCcAUCGUTsT | 43% | 2% | 60% | 9% |
| ND8390 | 211 | cuGAAcAcucuGGuuucccTsT | 212 | GGGAAACuAGAGUGUUcAGTsT | 33% | 2% | 48% | 11% |
| ND8391 | 213 | cuAuAAcAucuGcuGGAGuTsT | 214 | ACUCcAGcAGAUGUuAuAGTsT | 16% | 1% | 17% | 4% |
| ND8392 | 215 | GcAccAuAcuuucuGuAcTsT | 216 | GuAcAAGAAAGuAUGGUGCTsT | 19% | 1% | 22% | 4% |
| ND8393 | 217 | uGucuAGcccAucAuccuGTsT | 218 | cAGGAUGAUGGGCuAGAcATsT | 69% | 3% | 92% | 15% |
| ND8394 | 219 | AGGAcccuAGAccucuGcATsT | 220 | UGcAGAGGUCuAGGGUCCUTsT | 94% | 5% | 86% | 13% |
| ND8395 | 221 | ccAccGcuccuAccGAGAGTsT | 222 | CUCUCGGuAGGAGCGGUGGTsT | 55% | 1% | 65% | 6% |
| ND8396 | 223 | uAccGAGAGcucuucGAGuTsT | 224 | ACUCGAAGAGCUCUCGGuATsT | 11% | 1% | 11% | 1% |
| ND8397 | 225 | AAcAuccuGucGAGGcuGcTsT | 226 | GcAGCCUCGAcAGGAUGUUTsT | 90% | 7% | 72% | 11% |
| ND8398 | 227 | GAAccuuuAcccuucAAAGTsT | 228 | CUUUGAAGGGuAAAGGUUCTsT | 22% | 2% | 25% | 4% |
| ND8399 | 229 | GGuuccGAAGccGAuAcuGTsT | 230 | cAGuAUCGGCUUCGGAACCTsT | 93% | 9% | 89% | 9% |
| ND8400 | 231 | AAGccGAuAcuGGucuccATsT | 232 | UGGAGACcAGuAUCGGCUUTsT | 35% | 2% | 42% | 9% |
| ND8401 | 233 | ucuAGcccAucAuccuGcuTsT | 234 | AGcAGGAUGAUGGGCuAGATsT | 95% | 8% | 95% | 14% |
| ND8402 | 235 | cGGcGccAuccGccuGGuGTsT | 236 | cACcAGGCGGAUGGCGCCGTsT | 81% | 8% | 89% | 17% |
| ND8403 | 237 | uuuucGGAGAGuAcuucAGTsT | 238 | CUGAAGuACUCUCCGAAAATsT | 13% | 1% | 13% | 1% |
| ND8404 | 239 | GAGAGuAcuucAGcuAcccTsT | 240 | GGGuAGCUGAAGuACUCUCTsT | 71% | 3% | 100% | 10% |
| ND8405 | 241 | GAcGcucuuuGAccuGuAcTsT | 242 | GuAcAGGUcAAAGAGCGUCTsT | 84% | 5% | 92% | 13% |
| ND8406 | 243 | uGuGuAuucAcuccuGcuuTsT | 244 | AAGuAGGAGUGAAuAcAcATsT | 78% | 2% | 89% | 8% |
| ND8407 | 245 | AAcAAcAAGAGAAuGGAGTsT | 246 | CUCcAUUUCUCUUGUUGUUTsT | 66% | 3% | 88% | 21% |
| ND8408 | 247 | AuuGAAGGAuGuGcAGGGcTsT | 248 | GCCCUGcAcAUCCUUcAAUTsT | 25% | 1% | 36% | 6% |
| ND8409 | 249 | ucucAGAGccGcccAAAcuTsT | 250 | AGUUUGGGCGGCUCUGAGATsT | 18% | 1% | 24% | 2% |
| ND8410 | 251 | AAAcAcAAccAAGGGuAcATsT | 252 | UGuACCCUUGGUUGUGUUUTsT | 21% | 1% | 35% | 2% |
| ND8411 | 253 | uAcccGuGccccucAcAGAGTsT | 254 | CUCUGuGAGGGcACGGGuATsT | 57% | 2% | 67% | 4% |
| ND8412 | 255 | uAGcAcAcuAuAAcAucuGTsT | 256 | cAGAUGUuAuAGUGUGCuATsT | 30% | 2% | 41% | 1% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND8413 | 257 | GGuGuGuAuucAcuccuGcTsT | 258 | GcAGGAGUGAAuAcAcACCTsT | 73% | 1% | 90% | 9% |
| ND8414 | 259 | cAuGAucAAGGAGuGuGGcTsT | 260 | GCuAcACUCCUUGAUcAUGTsT | 65% | 2% | 67% | 5% |
| ND8415 | 261 | AcucAcGAuGGcccucGGuTsT | 262 | ACCGAGGGCcAUCGUGAGUTsT | 96% | 6% | 95% | 6% |
| ND8416 | 263 | GGAGcuuuGAcAAGGAAcuTsT | 264 | AGUUCCUUGUcAAAGCUCCTsT | 24% | 1% | 28% | 4% |
| ND8417 | 265 | AuAcccGuGcccucAcAGATsT | 266 | UCUGUGAGGGcACGGGuAUTsT | 54% | 1% | 62% | 2% |
| ND8418 | 267 | GGAGuGGccAAAGucAAcATsT | 268 | UGUUGACUUUGGCcACUCCTsT | 93% | 2% | 86% | 11% |
| ND8419 | 269 | AAcuAcAAAAccAAuucuGTsT | 270 | cAGAAUUGGUUUUGuAGUUTsT | 101% | 5% | 108% | 19% |
| ND8420 | 271 | uGcuGGAGuGuuGcuGuuGTsT | 272 | cAAcAGcAAcACUCcAGcATsT | 29% | 1% | 26% | 1% |
| ND8421 | 273 | AGGucuccuGcAAccAGGcTsT | 274 | GCCUGGUUGcAGGAGACCUTsT | 95% | 10% | 91% | 17% |
| ND8422 | 275 | cuuuGGcAuGAuGuAcuGGTsT | 276 | CcAGuAcAUcAUGCcAAAGTsT | 86% | 3% | 84% | 6% |
| ND8423 | 277 | cAucuGcAcccucAAucccTsT | 278 | GGGAUUGAGGGuGcAGAUGTsT | 82% | 11% | 73% | 4% |
| ND8424 | 279 | cGAcuGcAccAAGAAuGGcTsT | 280 | GCcAUUCUUGGUGcAGUCGTsT | 70% | 8% | 69% | 7% |
| ND8425 | 281 | AAAAcAcAAccAAGGGuAcTsT | 282 | GuACCCUUGGUUGUGUUUUTsT | 95% | 6% | 106% | 12% |
| ND8426 | 283 | cAucuGcuGGAGuGuuGcuTsT | 284 | AGcAAcACUCcAGcAGAUGTsT | 30% | 2% | 37% | 1% |
| ND8427 | 285 | ccuAcAucuucuAuccGcGTsT | 286 | CGCGGAuAGAAGAUGuAGGTsT | 42% | 6% | 30% | 1% |
| ND8428 | 287 | GccuAcAucuucuAuccGcTsT | 288 | GCGGAuAGAAGAUGuAGGCTsT | 65% | 7% | 54% | 3% |
| ND8429 | 289 | GAGuGGuAccGcuuccAcuTsT | 290 | AGUGGAAGCGGuACcACUCTsT | 95% | 11% | 86% | 19% |
| ND8430 | 291 | GGuAccGcuuccAcuAcAuTsT | 292 | AUGuAGUGGAAGCGGuACCTsT | 111% | 19% | 96% | 26% |
| ND8431 | 293 | GuGGuAccGcuuccAcuAcTsT | 294 | GuAGUGGAAGCGGuACcACTsT | 98% | 13% | 52% | 26% |
| ND8432 | 295 | GAAuuAcucucAcuuccAcTsT | 296 | GUGGAAGUGAGAGuAAUUCTsT | 111% | 21% | 73% | 27% |
| ND8433 | 297 | AAuuAcucucAcuuccAccTsT | 298 | GGUGGAAGUGAGAGuAAUUTsT | 109% | 22% | 105% | 7% |
| ND8434 | 299 | uAcucucAcuuccAccAccTsT | 300 | GGUGGUGGAAGUGAGAGuATsT | 106% | 23% | 95% | 7% |
| ND8435 | 301 | AGuGGuAccGcuuccAcuATsT | 302 | uAGUGGAAGCGGuACcACUTsT | 109% | 18% | 102% | 9% |
| ND8434 | 303 | GGGcAAcuucAucuucGccTsT | 304 | GGCGAAGAUGAAGUUGCCCTsT | 109% | 18% | 107% | 14% |
| ND-8501 | 305 | AGCCCGuAGCGuGGCCUCCTsT | 306 | GGAGGCCACGCuACGGGCUTsT | 84% | 14% | 69% | 3% |
| ND-8502 | 307 | CCGGGuAAuGGuGCACGGGTsT | 208 | CCCGuGCACCAUuACCCGGTsT | 41% | 6% | 30% | 2% |
| ND-8503 | 309 | AUGCuAUCGCGACAGAACATsT | 310 | UGUUCUGUCGCGAuAGCAUTsT | 11% | 2% | 10% | 2% |
| ND-8504 | 311 | UGCuAUCGCGACAGAACAATsT | 312 | UUGUUCUGUCGCGAuAGCATsT | 1% | 2% | 10% | 0% |
| ND-8505 | 313 | GCCCGUUuAUGuAUGCUCCTsT | 314 | GGAGCAuACAuAAACGGGCTsT | 23% | 3% | 16% | 1% |
| ND-8506 | 315 | GCCCGAUGCGuGGCCUCCATsT | 316 | UGGAGGCCACGCuACGGGCTsT | 32% | 3% | 22% | 1% |
| ND-8507 | 317 | CCGGAAAUuAAAGAGGAGCTsT | 318 | GCUCCUCUUuAAUUUCCGGTsT | 35% | 4% | 24% | 1% |
| ND-8508 | 319 | CCGAAGGUUCCGAAGCCGATsT | 320 | UCGGCUUCGGAACCUUCGGTsT | 19% | 2% | 13% | 1% |
| ND-8509 | 321 | GCAAUUCGGCCUGCUUUUCTsT | 322 | GAAAAGCAGGCCGAAUUGCTsT | 12% | 1% | 8% | 1% |
| ND-8510 | 323 | GGCGAAUuACUCUCACUUCTsT | 324 | GAAGUGAGAGuAAUUCGCCTsT | 21% | 2% | 18% | 1% |
| ND-8511 | 325 | GCGAAUuACUCUCACUUCCTsT | 326 | GGAAGUGAGAGuAAUUCGCTsT | 12% | 2% | 8% | 1% |
| ND-8512 | 327 | AACCAGGCGAAUuACUCUCTsT | 328 | GAGAGuAAUUCGCCUGGUUTsT | 99% | 11% | 79% | 5% |
| ND-8513 | 329 | GGuAAuGGuGCACGGGCAGTsT | 330 | CUGCCCGuGCACCAUuACCTsT | 61% | 6% | 42% | 4% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-8514 | 331 | CUCACGAUGGCCCUCGGUGTsT | 332 | CACCGAGGGCCAUCGUGAGTsT | 94% | 11% | 70% | 4% |
| ND-8515 | 333 | GCUCCGAAGGUUCCGAAGCTsT | 334 | GCUUCGGAACCUUCGGAGCTsT | 18% | 2% | 17% | 2% |
| ND-8516 | 335 | GCCGAUACUGGUCUCCAGGTsT | 336 | CCUGGAGACCAGUAUCGGCTsT | 14% | 1% | 12% | 1% |
| ND-8517 | 337 | CCGAUACUGGUCUCCAGGCTsT | 338 | GCCUGGAGACCAGUAUCGGTsT | 42% | 5% | 33% | 2% |
| ND-8518 | 339 | UGCUGUUGCACCAUACUUUTsT | 340 | AAAGUAUGGUGCAACAGCATsT | 10% | 1% | 9% | 0% |
| ND-8519 | 341 | AACGGUCUGUCCCUGAUGCTsT | 342 | GCAUCAGGGACAGACCGUUTsT | 60% | 7% | 52% | 8% |
| ND-8520 | 343 | UUAACUUGCGGCCUGGCGUTsT | 344 | ACGCCAGGCCGCAAGUUAATsT | 82% | 25% | 77% | 18% |
| ND-8521 | 345 | GCUGGUUACUCACGAUGGCTsT | 346 | GCCAUCGUGAGUAACCAGCTsT | 36% | 4% | 34% | 7% |
| ND-8522 | 347 | UUACUCACGAUGGCCCUCGTsT | 348 | CGAGGGCCAUCGUGAGUAATsT | 105% | 21% | 113% | 21% |
| ND-8523 | 349 | GAAGCCGAUACUGGUCUCCTsT | 350 | GGAGACCAGUAUCGGCUUCTsT | 24% | 2% | 18% | 2% |
| ND-8524 | 351 | GAUACUGGUCUCCAGGCCGTsT | 352 | CGGCCUGGAGACCAGUAUCTsT | 30% | 5% | 25% | 3% |
| ND-8525 | 353 | AUACUGGUCUCCAGGCCGATsT | 354 | UCGGCCUGGAGACCAGUAUTsT | 12% | 1% | 11% | 2% |
| ND-8526 | 355 | CAACGGUCUGUCCCUGAUGTsT | 356 | CAUCAGGGACAGACCGUUGTsT | 24% | 7% | 24% | 2% |
| ND-8527 | 357 | UUUAACUUGCGGCCUGGCGTsT | 358 | CGCCAGGCCGCAAGUUAAATsT | 122% | 6% | 107% | 9% |
| ND-8528 | 359 | UACUCACGAUGGCCCUCGGTsT | 360 | CCGAGGGCCAUCGUGAGUATsT | 78% | 6% | 84% | 7% |
| ND-8529 | 361 | UUUCGGAGAGUACUUCAGCTsT | 362 | GCUGAAGUACUCUCCGAAATsT | 87% | 18% | 80% | 17% |
| ND-8530 | 363 | GCAGACGCUCUUUGACCUGTsT | 364 | CAGGUCAAAGAGCGUCUGCTsT | 14% | 2% | 13% | 0% |
| ND-8531 | 365 | CUACAUCUUCUAUCCGCGGTsT | 366 | CCGCGGAUAGAAGAUGUAGTsT | 20% | 4% | 18% | 3% |
| ND-8532 | 367 | AGGCGAAUUACUCUCACUUTsT | 368 | AAGUGAGAGUAAUUCGCCUTsT | 25% | 5% | 18% | 1% |
| ND-8533 | 369 | CCGCUUCAACCAGGUCUCCTsT | 370 | GGAGACCUGGUUGAAGCGGTsT | 30% | 11% | 22% | 2% |
| ND-8534 | 371 | CAACCGCAUGAAGACGGCCTsT | 372 | GGCCGUCUUCAUGCGGUUGTsT | 33% | 4% | 23% | 1% |
| ND-8535 | 373 | AUGAAGACGGCCUUCUGGGTsT | 374 | CCCAGAAGGCCGUCUUCAUTsT | 114% | 12% | 84% | 15% |
| ND-8536 | 375 | AGCACAACCGCAUGAAGACTsT | 376 | GUCUUCAUGCGGUUGUGCUTsT | 18% | 1% | 16% | 3% |
| ND-8537 | 377 | UCGAGUUCCACCGCUCCUATsT | 378 | UAGGAGCGGUGGAACUCGATsT | 25% | 0% | 26% | 3% |
| ND-8538 | 379 | CUGCUUCUACCAGACAUACTsT | 380 | GUAUGUCUGGUAGAAGCAGTsT | 12% | 1% | 13% | 2% |
| ND-8539 | 381 | GAGGGAGUGGUACCGCUUCTsT | 382 | GAAGCGGUACCACUCCCUCTsT | 43% | 1% | 47% | 14% |
| ND-8540 | 383 | CCUUUAUGGAUGAUGGUGGTsT | 384 | CCACCAUCAUCCAUAAAGGTsT | 61% | 5% | 60% | 8% |
| ND-8541 | 385 | UGAGGGAGUGGUACCGCUUTsT | 386 | AAGCGGUACCACUCCCUCATsT | 36% | 5% | 35% | 5% |
| ND-8542 | 387 | CCUGCAACCAGGCGAAUUATsT | 388 | UAAUUCGCCUGGUUGCAGGTsT | 19% | 2% | 16% | 1% |
| ND-8543 | 389 | GGCCUGGCGUGGAGACCUCTsT | 390 | GAGGUCUCCACGCCAGGCCTsT | 28% | 7% | 20% | 2% |
| ND-8544 | 391 | UGCUUUUCGGAGAGUACUUTsT | 392 | AAGUACUCUCCGAAAAGCATsT | 22% | 5% | 17% | 1% |
| ND-8545 | 393 | CCCGUAGCGUGGCCUCCAGTsT | 394 | CUGGAGGCCACGCUACGGGTsT | 25% | 3% | 22% | 2% |
| ND-8546 | 395 | CCGUAGCGUGGCCUCCAGCTsT | 396 | GCUGGAGGCCACGCUACGGTsT | 62% | 5% | 57% | 9% |
| ND-8547 | 397 | CCAGGCGAAUUACUCUCACTsT | 398 | GUGAGAGUAAUUCGCCUGGTsT | 23% | 11% | 16% | 2% |
| ND-8548 | 399 | GAAACUGCUAUACUUUCAATsT | 400 | UUGAAAGUAUAGCAGUUUCTsT | 9% | 3% | 3% | 0% |
| ND-8549 | 401 | GCCCGGGUAAUGGUGCACGTsT | 402 | CGUGCACCAUUACCCGGGCTsT | 87% | 9% | 92% | 14% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-8550 | 403 | CCCGGGUAAUGGUGCACGGTsT | 404 | CCGUGCACCAUUACCCGGGTsT | 19% | 12% | 14% | 1% |
| ND-8551 | 405 | CGGGUAAUGGUGCACGGGCTsT | 406 | GCCCGUGCACCAUUACCCGTsT | 68% | 11% | 73% | 3% |
| ND-8552 | 407 | GGGUAAUGGUGCACGGGCATsT | 408 | UGCCCGUGCACCAUUACCCTsT | 30% | 6% | 33% | 2% |
| ND-8553 | 409 | UAAUGGUGCACGGGCAGGATsT | 410 | UCCUGCCCGUGCACCAUUATsT | 29% | 3% | 31% | 1% |
| ND-8554 | 411 | CUGGUUACUCACGAUGGCCTsT | 412 | GGCCAUCGUGAGUAACCAGTsT | 74% | 15% | 66% | 8% |
| ND-8555 | 413 | GUUACUCACGAUGGCCCUCTsT | 414 | GAGGGCCAUCGUGAGUAACTsT | 91% | 21% | 88% | 10% |
| ND-8556 | 415 | UGUCACGAUGGUCACCCUCTsT | 416 | GAGGGUGACCAUCGUGACATsT | 72% | 4% | 76% | 12% |
| ND-8557 | 417 | UGCUCCGAAGGUUCCGAAGTsT | 418 | CUUCGGAACCUUCGGAGCATsT | 51% | 2% | 59% | 18% |
| ND-8558 | 419 | UCCGAAGGUUCCGAAGCCGTsT | 420 | CGGCUUCGGAACCUUCGGATsT | 109% | 11% | 77% | 13% |
| ND-8559 | 421 | UUCCGAAGCCGAUACUGGUTsT | 422 | ACCAGUAUCGGCUUCGGAATsT | 46% | 20% | 33% | 6% |
| ND-8560 | 423 | AGCCGAUACUGGUCUCCAGTsT | 424 | CUGGAGACCAGUAUCGGCUTsT | 15% | 6% | 10% | 1% |
| ND-8561 | 425 | CUUGGUACUGCCUCUGAACTsT | 426 | GUUCAGAGGCAGUACCAAGTsT | 16% | 3% | 12% | 3% |
| ND-8562 | 427 | CUCCCGUAGCACACUAUAATsT | 428 | UUAUAGUGUGCUACGGGAGTsT | 14% | 6% | 10% | 1% |
| ND-8563 | 429 | UCCCGUAGCACACUAUAACTsT | 430 | GUUAUAGUGUGCUACGGGATsT | 43% | 11% | 36% | 4% |
| ND-8564 | 431 | UGCACCAUACUUUCUUGUATsT | 432 | UACAAGAAAGUAUGGUGCATsT | 17% | 6% | 13% | 3% |
| ND-8565 | 433 | UUGCCCGUUUAUGUAUGCUTsT | 434 | AGCAUACAUAAACGGGCAATsT | 84% | 2% | 103% | 12% |
| ND-8566 | 435 | UGCCCGUUUAUGUAUGCUCTsT | 436 | GAGCAUACAUAAACGGGCATsT | 69% | 25% | 93% | 4% |
| ND-8567 | 437 | GGACCCUAGACCUCUGCAGTsT | 438 | CUGCAGAGGUCUAGGGUCCTsT | 29% | 8% | 33% | 2% |
| ND-8568 | 439 | CCUAGACCUCUGCAGCCCATsT | 440 | UGGGCUGCAGAGGUCUAGGTsT | 18% | 2% | 19% | 1% |
| ND-8569 | 441 | UGGCAUGAUGUACUGGCAATsT | 442 | UUGCCAGUACAUCAUGCCATsT | 19% | 3% | 20% | 5% |
| ND-8570 | 443 | UACUGGCAAUUCGGCCUGTsT | 444 | GCAGGCCGAAUUGCCAGUATsT | 86% | 15% | 83% | 16% |
| ND-8571 | 445 | AAUUCGGCCUGCUUUUCGGTsT | 446 | CCGAAAAGCAGGCCGAAUUTsT | 19% | 3% | 24% | 4% |
| ND-8572 | 447 | CUGCUUUUCGGAGAGUACUTsT | 448 | AGUACUCUCCGAAAAGCAGTsT | 8% | 2% | 40% | 2% |
| ND-8573 | 449 | UUCGGAGAGUACUUCAGCUTsT | 450 | AGCUGAAGUACUCUCCGAATsT | 27% | 3% | 40% | 5% |
| ND-8574 | 451 | AGCAGACGCUCUUUGACCUTsT | 452 | AGGUCAAAGAGCGUCUGCUTsT | 15% | 0% | 19% | 4% |
| ND-8575 | 453 | CUUGCAGCGCCUGAGGGUCTsT | 454 | GACCCUCAGGCGCUGCAAGTsT | 35% | 1% | 40% | 4% |
| ND-8576 | 455 | UGGCUUUAACUUGCGGCCUTsT | 456 | AGGCCGCAAGUUAAAGCCATsT | 7% | 3% | 53% | 8% |
| ND-8577 | 457 | GCUUUAACUUGCGGCCUGGTsT | 458 | CCAGGCCGCAAGUUAAAGCTsT | 20% | 2% | 25% | 5% |
| ND-8578 | 459 | UAACUUGCGGCCUGGCGUGTsT | 460 | CACGCCAGGCCGCAAGUUATsT | 75% | 7% | 82% | 4% |
| ND-8579 | 461 | ACCUUUACCCUUCAAAGUATsT | 462 | UACUUUGAAGGGUAAAGGUTsT | 14% | 2% | 17% | 3% |
| ND-8580 | 463 | GGUUACUCACGAUGGCCCUTsT | 464 | AGGGCCAUCGUGAGUAACCTsT | 63% | 5% | 70% | 11% |
| ND-8581 | 465 | CACGAUGGCCCUCGGUGACTsT | 466 | GUCACCGAGGGCCAUCGUGTsT | 56% | 2% | 50% | 5% |
| ND-8582 | 467 | AGAUGCUAUCGCGACAGAATsT | 468 | UUCUGUCGCGAUAGCAUCUTsT | 18% | 1% | 18% | 1% |
| ND-8583 | 469 | ACGAUGGUCACCCUCCUGUTsT | 470 | ACAGGAGGGUGACCAUCGUTsT | 48% | 3% | 52% | 6% |
| ND-8584 | 471 | CUCCGAAGGUUCCGAAGCCTsT | 472 | GGCUUCGGAACCUUCGGAGTsT | 18% | 2% | 20% | 5% |
| ND-8585 | 473 | AAGGUUCCGAAGCCGAUACTsT | 474 | GUAUCGGCUUCGGAACCUUTsT | 26% | 2% | 28% | 1% |
| ND-8586 | 475 | GGUACUGCCUCUGAACACUTsT | 476 | AGUGUUCAGAGGCAGUACCTsT | 12% | 1% | 12% | 1% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-8587 | 477 | AGCUUUGACAAGGAACUUUUTsT | 478 | AAAGUUCCUUGUCAAAGCUTsT | 17% | 2% | 18% | 2% |
| ND-8588 | 479 | UUUGACAAGGAACUUUCCUTsT | 480 | AGGAAAGUUCCUUGUCAAATsT | 78% | 5% | 73% | 2% |
| ND-8589 | 481 | UGACAAGGAACUUUCCUAATsT | 482 | UUAGGAAAGUUCCUUGUCATsT | 14% | 1% | 16% | 1% |
| ND-8590 | 483 | CCCGUAGCACACUAUAACATsT | 484 | UGUUAUAGUGUGCUACGGGTsT | 9% | 1% | 11% | 2% |
| ND-8591 | 485 | CACUAUAACAUCUGCUGGATsT | 486 | UCCAGCAGAUGUUAUAGUGTsT | 18% | 2% | 20% | 2% |
| ND-8592 | 487 | UUGCUGUUGCACCAUACUUTsT | 488 | AAGUAUGGUGCAACAGCAATsT | 23% | 2% | 25% | 8% |
| ND-8593 | 489 | GUACUGGCAAUUCGGCCUGTsT | 490 | CAGGCCGAAUUGCCAGUACTsT | 66% | 3% | 62% | 4% |
| ND-8594 | 491 | UUCGGCCUGCUUUUCGGAGTsT | 492 | CUCCGAAAAGCAGGCCGAATsT | 97% | 7% | 86% | 8% |
| ND-8595 | 493 | CCUGCUUUUCGGAGAGUACTsT | 494 | GUACUCUCCGAAAAGCAGGTsT | 11% | 2% | 14% | 3% |
| ND-8596 | 495 | GCUUUUCGGAGAGUACUUCTsT | 496 | GAAGUACUCUCCGAAAAGCTsT | 12% | 1% | 17% | 2% |
| ND-8597 | 497 | CUUUUCGGAGAGUACUUCATsT | 498 | UGAAGUACUCUCCGAAAAGTsT | 11% | 1% | 14% | 2% |
| ND-8598 | 499 | CAACCUCAACUCGGACAAGTsT | 500 | CUUGUCCGAGUUGAGGUUGTsT | 15% | 2% | 16% | 2% |
| ND-8599 | 501 | CUACCAGACAUACUCAUCATsT | 502 | UGAUGAGUAUGUCUGGUAGTsT | 17% | 1% | 18% | 2% |
| ND-8600 | 503 | CUGUCGAGGCUGCCAGAGATsT | 504 | UCUCUGGCAGCCUCGACAGTsT | 17% | 0% | 16% | 1% |
| ND-8601 | 505 | AAACUGCUAUACUUUCAAUTsT | 506 | AUUGAAAGUAUAGCAGUUUTsT | 28% | 1% | 26% | 1% |
| ND-8602 | 507 | GGCUUUAACUUGCGGCCUGTsT | 508 | CAGGCCGCAAGUUAAAGCCTsT | 21% | 2% | 18% | 1% |
| ND-8603 | 509 | CUUUAACUUGCGGCCUGGCTsT | 510 | GCCAGGCCGCAAGUUAAAGTsT | 81% | 2% | 69% | 6% |
| ND-8604 | 511 | AGGUGUGUAUUCACUCCUGTsT | 512 | CAGGAGUGAAUACACACCUTsT | 47% | 4% | 40% | 1% |
| ND-8605 | 513 | ACGAUGGCCCUCGGUGACATsT | 514 | UGUCACCGAGGGCCAUCGUTsT | 40% | 6% | 35% | 2% |
| ND-8606 | 515 | CUGAACACUCUGGUUUCCCTsT | 516 | GGGAAACCAGAGUGUUCAGTsT | 60% | 2% | 75% | 4% |
| ND-8607 | 517 | CUAUAACAUCUGCUGGAGUTsT | 518 | ACUCCAGCAGAUGUUAUAGTsT | 17% | 1% | 24% | 3% |
| ND-8608 | 519 | GCACCAUACUUUCUUGUACTsT | 520 | GUACAAGAAAGUAUGGUGCTsT | 10% | 1% | 15% | 3% |
| ND-8609 | 521 | UGUCUAGCCCAUCAUCCUGTsT | 522 | CAGGAUGAUGGGCUAGACATsT | 62% | 2% | 75% | 12% |
| ND-8610 | 523 | AGGACCCUAGACCUCUGCATsT | 524 | UGCAGAGGUCUAGGGUCCUTsT | 61% | 5% | 73% | 10% |
| ND-8611 | 525 | CCACCGCUCCUACCGAGAGTsT | 526 | CUCUCGGUAGGAGCGGUGGTsT | 21% | 2% | 29% | 5% |
| ND-8612 | 527 | UACCGAGAGCUCUUCGAGUTsT | 528 | ACUCGAAGAGCUCUCGGUATsT | 13% | 1% | 22% | 3% |
| ND-8613 | 529 | AACAUCCUGUCGAGGCUGCTsT | 530 | GCAGCCUCGACAGGAUGUUTsT | 57% | 2% | 70% | 4% |
| ND-8614 | 531 | GAACCUUUACCCUUCAAAGTsT | 532 | CUUUGAAGGGUAAAGGUUCTsT | 13% | 3% | 16% | 2% |
| ND-8615 | 533 | GGUUCCGAAGCCGAUACUGTsT | 534 | CAGUAUCGGCUUCGGAACCTsT | 18% | 1% | 24% | 2% |
| ND-8616 | 535 | AAGCCGAUACUGGUCUCCATsT | 536 | UGGAGACCAGUAUCGGCUUTsT | 19% | 1% | 25% | 2% |
| ND-8617 | 537 | UCUAGCCCAUCAUCCUGCUTsT | 538 | AGCAGGAUGAUGGGCUAGATsT | 93% | 3% | 101% | 3% |
| ND-8618 | 539 | CGGCGCCAUCCGCCUGGUGTsT | 540 | CACCAGGCGGAUGGCGCCGTsT | 85% | 4% | 99% | 4% |
| ND-8619 | 541 | UUUUCGGAGAGUACUUCAGTsT | 542 | CUGAAGUACUCUCCGAAAATsT | 63% | 2% | 77% | 3% |
| ND-8620 | 543 | GAGAGUACUUCAGCUACCCTsT | 544 | GGGUAGCUGAAGUACUCUCTsT | 26% | 1% | 30% | 4% |
| ND-8621 | 545 | GACGCUCUUUGACCUGUACTsT | 546 | GUACAGGUCAAAGAGCGUCTsT | 17% | 2% | 19% | 3% |
| ND-8622 | 547 | UGUGUAUUCACUCCUGCUUTsT | 548 | AAGCAGGAGUGAAUACACATsT | 49% | 3% | 58% | 11% |

TABLE 1A-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-8623 | 549 | AACAACAAGAGAAAUGGAGUsT | 550 | CUCCAUUUCUCUUGUUGUUUsT | 74% | 7% | 70% | 4% |
| ND-8624 | 551 | AUUGAAGGAUGUGCAGGGCUsT | 552 | GCCCUGCACAUCCUUCAAUUsT | 85% | 6% | 87% | 12% |
| ND-8625 | 553 | UCUCAGAGCCGCCCAAACUUsT | 554 | AGUUUGGGCGGCUCUGAGAUsT | 53% | 3% | 51% | 6% |
| ND-8626 | 555 | AAACACAACCAAGGGUACAUsT | 556 | UGUACCCUUGGUUGUGUUUsT | 17% | 2% | 18% | 2% |
| ND-8627 | 557 | UACCCGUGCCCUCACAGAGUsT | 558 | CUCUGUGAGGGCACGGGUAUsT | 58% | 3% | 55% | 3% |
| ND-8628 | 559 | UAGCACACUAUAACAUCUGUsT | 560 | CAGAUGUUAUAGUGUGCUAUsT | 64% | 3% | 64% | 15% |
| ND-8629 | 561 | GGUGUGUAUUCACUCCUGCUsT | 562 | GCAGGAGUGAAUACACACCUsT | 25% | 3% | 23% | 2% |
| ND-8630 | 563 | CAUGAUCAAGGAGUGUGGCUsT | 564 | GCCACACUCCUUGAUCAUGUsT | 32% | 2% | 28% | 2% |
| ND-8631 | 565 | ACUCACGAUGGCCCUCGGUUsT | 566 | ACCGAGGGCCAUCGUGAGUUsT | 96% | 1% | 88% | 4% |
| ND-8632 | 567 | GGAGCUUUGACAAGGAACUUsT | 568 | AGUUCCUUGUCAAAGCUCCUsT | 14% | 1% | 14% | 2% |
| ND-8633 | 569 | AUACCCGUGCCCUCACAGAUsT | 570 | UCUGUGAGGGCACGGGUAUUsT | 21% | 2% | 16% | 1% |
| ND-8634 | 571 | GGAGUGGCCAAAGUCAACAUsT | 572 | UGUUGACUUUGGCCACUCCUsT | 21% | 3% | 16% | 1% |
| ND-8635 | 573 | AACUACAAAACCAAUUCUGUsT | 574 | CAGAAUUGGUUUUGUAGUUUsT | 49% | 5% | 37% | 3% |
| ND-8636 | 575 | UGCUGGAGUGUUGCUGUUGUsT | 576 | CAACAGCAACACUCCAGCAUsT | 27% | 3% | 21% | 2% |
| ND-8637 | 577 | AGGUCUCCUGCAACCAGGCUsT | 578 | GCCUGGUUGCAGGAGACCUUsT | 62% | 8% | 61% | 4% |
| ND-8638 | 579 | CUUUGGCAUGAUGUACUGGUsT | 580 | CCAGUACAUCAUGCCAAAGUsT | 66% | 6% | 52% | 8% |
| ND-8639 | 581 | CAUCUGCACCCUCAAUCCCUsT | 582 | GGGAUUGAGGGUGCAGAUGUsT | 50% | 7% | 40% | 4% |
| ND-8640 | 583 | CGACUGCACCAAGAAUGGCUsT | 584 | GCCAUUCUUGGUGCAGUCGUsT | 67% | 6% | 54% | 5% |
| ND-8641 | 585 | AAAACACAACCAAGGGUACUsT | 586 | GUACCCUUGGUUGUGUUUUsT | 14% | 2% | 14% | 1% |
| ND-8642 | 587 | CAUCUGCUGGAGUGUUGCUUsT | 588 | AGCAACACUCCAGCAGAUGUsT | 13% | 2% | 13% | 1% |
| ND-8643 | 589 | CCUACAUCUUCUAUCCGCGUsT | 590 | CGCGGAUAGAAGAUGUAGGUsT | 15% | 4% | 13% | 0% |
| ND-8644 | 591 | GCCUACAUCUUCUAUCCGCUsT | 592 | GCGGAUAGAAGAUGUAGGCUsT | 14% | 3% | 11% | 1% |
| ND-8645 | 593 | GAGUGGUACCGCUUCCACUUsT | 594 | AGUGGAAGCGGUACCACUCUsT | 16% | 0% | 20% | 1% |
| ND-8646 | 595 | GGUACCGCUUCCACUACAUUsT | 596 | AUGUAGUGGAAGCGGUACCUsT | 12% | 0% | 14% | 1% |
| ND-8647 | 597 | GUGGUACCGCUUCCACUACUsT | 598 | GUAGUGGAAGCGGUACCACUsT | 42% | 4% | 44% | 3% |
| ND-8648 | 599 | GAAUUACUCUCACUUCCACUsT | 600 | GUGGAAGUGAGAGUAAUUCUsT | 10% | 1% | 11% | 3% |
| ND-8649 | 601 | AAUUACUCUCACUUCCACCUsT | 602 | GGUGGAAGUGAGAGUAAUUUsT | 105% | 10% | 102% | 8% |
| ND-8650 | 603 | UACUCUCACUUCCACCACCUsT | 604 | GGUGGUGGAAGUGAGAGUAUsT | 55% | 6% | 54% | 8% |
| ND-8651 | 605 | AGUGGUACCGCUUCCACUAUsT | 606 | UAGUGGAAGCGGUACCACUUsT | 57% | 6% | 59% | 12% |
| ND-8652 | 607 | GGGCAACUUCAUCUUCGCCUsT | 608 | GGCGAAGAUGAAGUUGCCCUsT | 47% | 12% | 36% | 7% |

Table 1B: Selected siRNAs in extended screening set ("human-only" siRNAs). A further 344 iRNA sequences were identified and were designed to be fully complementary to the human alpha-ENaC sequences, according to the design criteria described in the examples section. All siRNAs listed in this screening set were modified only with a phosphorothioate linkage at the 3'-end between nucleotides 20 and 21 of each strand. The percentage residual expression of alpha-ENaC in single-dose transfection assay is shown (refer to examples section for methods used).

TABLE 1B

| Duplex ID | Seq ID | Sense | Seq ID | Antisense | 1st screen single dose @ 50 nM in H441; MV | SD |
|---|---|---|---|---|---|---|
| ND-10445 | 609 | CUGCGGCUAAGUCUCUUUUTsT | 610 | AAAAGAGACUUAGCCGCAGTsT | 94% | 8% |
| ND-10446 | 611 | AUCGCGACAGAACAAUUACTsT | 612 | GUAAUUGUUCUGUCGCGAUTsT | 13% | 2% |
| ND-10447 | 613 | UCGCGACAGAACAAUUACATsT | 614 | UGUAAUUGUUCUGUCGCGATsT | 18% | 1% |
| ND-10448 | 615 | CCCGUUUAUGUAUGCUCCATsT | 616 | UGGAGCAUACAUAAACGGGTsT | 41% | 1% |
| ND-10449 | 617 | CCCGGGUAAGUAAAGGCAGTsT | 618 | CUGCCUUUACUUACCCGGGTsT | 23% | 1% |
| ND-10450 | 619 | GGUACCCGGAAAUUAAAGATsT | 620 | UCUUUAAUUUCCGGGUACCTsT | 14% | 2% |
| ND-10451 | 621 | GCUAUCGCGACAGAACAAUTsT | 622 | AUUGUUCUGUCGCGAUAGCTsT | 24% | 2% |
| ND-10452 | 623 | UAUCGCGACAGAACAAUUATsT | 624 | UAAUUGUUCUGUCGCGAUATsT | 12% | 1% |
| ND-10453 | 625 | UGCGGCUAAGUCUCUUUUTsT | 626 | AAAAGAGACUUAGCCGCATsT | 46% | 3% |
| ND-10454 | 627 | GGCGAUUAUGGCGACUGCATsT | 628 | UGCAGUCGCCAUAAUCGCCTsT | 14% | 0% |
| ND-10455 | 629 | AUGUCUAGCCCAUCAUCCUTsT | 630 | AGGAUGAUGGGCUAGACAUTsT | 12% | 2% |
| ND-10456 | 631 | CUACAGGUACCCGGAAAUUTsT | 632 | AAUUUCCGGGUACCUGUAGTsT | 28% | 2% |
| ND-10457 | 633 | CCGUCGAGCCCGUAGCGUGTsT | 634 | CACGCUACGGGCUCGACGGTsT | 27% | 3% |
| ND-10458 | 635 | CGCGACAGAACAAUUACACTsT | 636 | GUGUAAUUGUUCUGUCGCGTsT | 39% | 7% |
| ND-10459 | 637 | AGGUACCCGGAAAUUAAAGTsT | 638 | CUUUAAUUUCCGGGUACCUTsT | 30% | 3% |
| ND-10460 | 639 | CAUGCACGGGUUUCCUGCCTsT | 640 | GGCAGGAAACCCGUGCAUGTsT | 95% | 6% |
| ND-10461 | 641 | AGCUUGCGGGACAACAACCTsT | 642 | GGUUGUUGUCCCGCAAGCUTsT | 94% | 8% |
| ND-10462 | 643 | ACUGCGGCUAAGUCUCUUUTsT | 644 | AAAGAGACUUAGCCGCAGUTsT | 13% | 2% |
| ND-10463 | 645 | CAUCCCUUAGAACCCUGCUTsT | 646 | AGCAGGGUUCUAAGGGAUGTsT | 18% | 1% |
| ND-10464 | 647 | ACCCGGGUAAGUAAAGGCATsT | 648 | UGCCUUUACUUACCCGGGUTsT | 41% | 1% |
| ND-10465 | 649 | GAUUAUGGCGACUGCACCATsT | 650 | UGGUGCAGUCGCCAUAAUCTsT | 23% | 1% |
| ND-10466 | 651 | CUCGGACAAGCUCGUCUUCTsT | 652 | GAAGACGAGCUUGUCCGAGTsT | 14% | 2% |
| ND-10467 | 653 | GCGAUUAUGGCGACUGCACTsT | 654 | GUGCAGUCGCCAUAAUCGCTsT | 24% | 2% |
| ND-10468 | 655 | AAUUACACCGUCAACAACATsT | 656 | UGUUGUUGACGGUGUAAUUTsT | 12% | 1% |
| ND-10469 | 657 | AACUGCCGUUGAUGUGUGGTsT | 658 | CCACACAUCAACGGCAGUUTsT | 46% | 3% |
| ND-10470 | 659 | AACUGCGGCUAAGUCUCUUTsT | 660 | AAGAGACUUAGCCGCAGUUTsT | 14% | 0% |
| ND-10471 | 661 | CCGCUGAUAACCAGGACAATsT | 662 | UUGUCCUGGUUAUCAGCGGTsT | 12% | 2% |
| ND-10472 | 663 | AAGGGUACACGCAGGCAUGTsT | 664 | CAUGCCUGCGUGUACCCUUTsT | 28% | 2% |
| ND-10473 | 665 | CCGGGUAAGUAAAGGCAGATsT | 666 | UCUGCCUUUACUUACCCGGTsT | 27% | 3% |
| ND-10474 | 667 | CCCAUACCAGGUCUCAUGGTsT | 668 | CCAUGAGACCUGGUAUGGGTsT | 39% | 7% |
| ND-10475 | 669 | AUUAUGGCGACUGCACCAATsT | 670 | UUGGUGCAGUCGCCAUAAUTsT | 30% | 3% |
| ND-10476 | 671 | AUGCACGGGUUUCCUGCCCTsT | 672 | GGGCAGGAAACCCGUGCAUTsT | 95% | 6% |
| ND-10477 | 673 | CUAGCCCUCCACAGUCCACTsT | 674 | GUGGACUGUGGAGGGCUAGTsT | 43% | 7% |
| ND-10478 | 675 | CAGGUACCCGGAAAUUAAATsT | 676 | UUUAAUUUCCGGGUACCUGTsT | 11% | 1% |
| ND-10479 | 677 | AAUACAGCUCCUUCACCACTsT | 678 | GUGGUGAAGGAGCUGUAUUTsT | 30% | 3% |
| ND-10480 | 679 | CACGGGUUUCCUGCCCAGCTsT | 680 | GCUGGGCAGGAAACCCGCGTsT | 19% | 1% |
| ND-10481 | 681 | GGACUGAAUCUUGCCCGUUTsT | 682 | AACGGGCAAGAUUCAGUCCTsT | 14% | 2% |

TABLE 1B-continued

| | | | | | | | |
|---|---|---|---|---|---|---|---|
| ND-10482 | 683 | CGUUUAUGUAUGCUCCAUGTsT | 684 | CAUGGAGCAUACAUAAACGTsT | 15% | 1% |
| ND-10483 | 685 | GGGUACUGCUACUAUAAGCTsT | 686 | GCUUAUAGUAGCAGUACCCTsT | 11% | 0% |
| ND-10484 | 687 | UCGGUGUUGUCUGUGGUGGTsT | 688 | CCACCACAGACAACACCGATsT | 65% | 5% |
| ND-10485 | 689 | AAACUGCCGUUGAUGUGUGTsT | 690 | CACACAUCAACGGCAGUUUTsT | 73% | 6% |
| ND-10486 | 691 | GCGAAACUUGGAGCUUUGATsT | 692 | UCAAAGCUCCAAGUUUCGCTsT | 8% | 1% |
| ND-10487 | 693 | GGCCCGUCGAGCCCGUAGCTsT | 694 | GCUACGGGCUCGACGGGCCTsT | 26% | 3% |
| ND-10488 | 695 | GCGACAGAACAAUUACACCTsT | 696 | GGUGUAAUUGUUCUGUCGCTsT | 10% | 2% |
| ND-10489 | 697 | GCGACGGCUUAAGCCAGCCTsT | 698 | GGCUGGCUUAAGCCGUCGCTsT | 50% | 1% |
| ND-10490 | 699 | GACCCGGGUAAGUAAAGGCTsT | 700 | GCCUUUACUUACCCGGGUCTsT | 74% | 1% |
| ND-10491 | 701 | UUGAUCACUCCGCCUUCUCTsT | 702 | GAGAAGGCGGAGUGAUCAATsT | 80% | 7% |
| ND-10492 | 703 | UCUAGCCCUCCACAGUCCATsT | 704 | UGGACUGUGGAGGGCUAGATsT | 69% | 4% |
| ND-10493 | 705 | GUUUCACCAAGUGCCGGAATsT | 706 | UUCCGGCACUUGGUGAAACTsT | 23% | 3% |
| ND-10494 | 707 | CUCAACUCGGACAAGCUCGTsT | 708 | CGAGCUUGUCCGAGUUGAGTsT | 45% | 6% |
| ND-10495 | 709 | CAACUCGGACAAGCUCGUCTsT | 710 | GACGAGCUUGUCCGAGUUGTsT | 23% | 3% |
| ND-10496 | 711 | ACCCGGAAAUUAAAGAGGATsT | 712 | UCCUCUUUAAUUUCCGGGUTsT | 13% | 2% |
| ND-10497 | 713 | CCCGGAAAUUAAAGAGGAGTsT | 714 | CUCCUCUUUAAUUUCCGGGTsT | 19% | 1% |
| ND-10498 | 715 | CACCACUCUCGUGGCCGGCTsT | 716 | GCCGGCCACGAGAGUGGUGTsT | 94% | 11% |
| ND-10499 | 717 | CGUCGAGCCCGUAGCUGGGTsT | 718 | CCCACGCUACGGGCUCGACGTsT | 13% | 1% |
| ND-10500 | 719 | GCUUGCGGGACAACAACCCTsT | 720 | GGGUUGUUGUCCCGCAAGCTsT | 49% | 2% |
| ND-10501 | 721 | GAAUCAACAACGGUCUGUCTsT | 722 | GACAGACCGUUGUUGAUUCTsT | 18% | 2% |
| ND-10502 | 723 | GGGCGAUUAUGGCGACUGCTsT | 724 | GCAGUCGCCAUAAUCGCCCTsT | 8% | 1% |
| ND-10503 | 725 | CGAUUAUGGCGACUGCACCTsT | 726 | GGUGCAGUCGCCAUAAUCGTsT | 17% | 1% |
| ND-10504 | 727 | UCUGCUGGUUACUCACGAUTsT | 728 | AUCGUGAGUAACCAGCAGATsT | 38% | 4% |
| ND-10505 | 729 | CUAUCGCGACAGAACAAUUTsT | 730 | AAUUGUUCUGUCGCGAUAGTsT | 9% | 1% |
| ND-10506 | 731 | CAAUUACACCGUCAACAACTsT | 732 | GUUGUUGACGGUGUAAUUGTsT | 11% | 1% |
| ND-10507 | 733 | ACCGUCAACAACAAGAGAATsT | 734 | UUCUCUUGUUGUUGACGGUTsT | 9% | 1% |
| ND-10508 | 735 | CUCCUCGGUGUUGUCUGUGTsT | 736 | CACAGACAACACCGAGGAGTsT | 78% | 5% |
| ND-10509 | 737 | GGAGGUAGCCUCCACCCUGTsT | 738 | CAGGGUGGAGGCUACCUCCTsT | 18% | 1% |
| ND-10510 | 739 | GGAGAGGUUUCUCACACCATsT | 740 | UGGUGUGAGAAACCUCUCCTsT | 13% | 1% |
| ND-10511 | 741 | CUGCCGUUGAUGUGUGGAGTsT | 742 | CUCCACACAUCAACGGCAGTsT | 19% | 2% |
| ND-10512 | 743 | UGCCGUUGAUGUGUGGAGGTsT | 744 | CCUCCACACAUCAACGGCATsT | 82% | 4% |
| ND-10513 | 745 | AGAUGGGUAAGGGCUCAGGTsT | 746 | CCUGAGCCCUUACCCAUCUTsT | 24% | 1% |
| ND-10514 | 747 | AGAACAGUAGCUGAUGAAGTsT | 748 | CUUCAUCAGCUACUGUUCUTsT | 15% | 0% |
| ND-10515 | 749 | GCGGCUAAGUCUCUUUUUCTsT | 750 | GAAAAAGAGACUUAGCCGCTsT | 13% | 1% |
| ND-10516 | 751 | CCUAAGAAACCGCUGAUAATsT | 752 | UUAUCAGCGGUUUCUUAGGTsT | 6% | 0% |
| ND-10517 | 753 | GAAACCGCUGAUAACCAGGTsT | 754 | CCUGGUUAUCAGCGGUUUCTsT | 13% | 0% |
| ND-10518 | 755 | AACCGCUGAUAACCAGGACTsT | 756 | GUCCUGGUUAUCAGCGGUUTsT | 42% | 2% |
| ND-10519 | 757 | ACCGCUGAUAACCAGGACATsT | 758 | UGUCCUGGUUAUCAGCGGUTsT | 11% | 1% |
| ND-10520 | 759 | CCAAGGGUACACGCAGGCATsT | 760 | UGCCUGCGUGUACCCUUGGTsT | 19% | 1% |
| ND-10521 | 761 | CAAGGGUACACGCAGGCAUTsT | 762 | AUGCCUGCGUGUACCCUUGTsT | 12% | 0% |

TABLE 1B-continued

| | | | | | |
|---|---|---|---|---|---|
| ND-10522 | 763 | AGGGUACACGCAGGCAUGCTsT | 764 | GCAUGCCUGCGUGUACCCUTsT | 23% | 1% |
| ND-10523 | 765 | GUACACGCAGGCAUGCACGTsT | 766 | CGUGCAUGCCUGCGUGUACTsT | 27% | 1% |
| ND-10524 | 767 | AGGCAUGCACGGGUUUCCUTsT | 768 | AGGAAACCCGUGCAUGCCUTsT | 14% | 0% |
| ND-10525 | 769 | GGCAUGCACGGGUUUCCUGTsT | 770 | CAGGAAACCCGUGCAUGCCTsT | 18% | 3% |
| ND-10526 | 771 | ACGGGUUUCCUGCCCAGCGTsT | 772 | CGCUGGGCAGGAAACCCGUTsT | 30% | 1% |
| ND-10527 | 773 | GAGCAGACCCGGGUAAGUATsT | 774 | UACUUACCCGGGUCUGCUCTsT | 24% | 2% |
| ND-10528 | 775 | AGCAGACCCGGGUAAGUAATsT | 776 | UUACUUACCCGGGUCUGCUTsT | 24% | 2% |
| ND-10529 | 777 | GGGUAAGUAAAGGCAGACCTsT | 778 | GGUCUGCCUUUACUUACCCTsT | 39% | 3% |
| ND-10530 | 779 | AGCCUCAUACCCGUGCCCUTsT | 780 | AGGGCACGGGUAUGAGGCUTsT | 82% | 5% |
| ND-10531 | 781 | GUGAACGCUUCUGCCACAUTsT | 782 | AUGUGGCAGAAGCGUUCACTsT | 13% | 1% |
| ND-10532 | 783 | AAAUUGAUCACUCCGCCUUTsT | 784 | AAGGCGGAGUGAUCAAUUUTsT | 18% | 2% |
| ND-10533 | 785 | AAUUGAUCACUCCGCCUUCTsT | 786 | GAAGGCGGAGUGAUCAAUUTsT | 19% | 0% |
| ND-10534 | 787 | GCCUUGCGGUCAGGGACUGTsT | 788 | CAGUCCCUGACCGCAAGGCTsT | 12% | 1% |
| ND-10535 | 789 | CUUGCGGUCAGGGACUGAATsT | 790 | UUCAGUCCCUGACCGCAAGTsT | 11% | 0% |
| ND-10536 | 791 | UUGCGGUCAGGGACUGAAUTsT | 792 | AUUCAGUCCCUGACCGCAATsT | 12% | 0% |
| ND-10537 | 793 | AUGUAUGCUCCAUGUCUAGTsT | 794 | CUAGACAUGGAGCAUACAUTsT | 21% | 1% |
| ND-10538 | 795 | AGCAAGUAGGCAGGAGCUCTsT | 796 | GAGCUCCUGCCUACUUGCUTsT | 19% | 1% |
| ND-10539 | 797 | CAGCCCAUACCAGGUCUCATsT | 798 | UGAGACCUGGUAUGGGCUGTsT | 27% | 2% |
| ND-10540 | 799 | CAGCCGUCGCGACCUGCGGTsT | 800 | CCGCAGGUCGCGACGGCUGTsT | 44% | 4% |
| ND-10541 | 801 | GGGCCCGUCGAGCCCGUAGTsT | 802 | CUACGGGCUCGACGGGCCCTsT | 71% | 6% |
| ND-10542 | 803 | CGUAGCGUGGCCUCCAGCUTsT | 804 | AGCUGGAGGCCACGCUACGTsT | 84% | 9% |
| ND-10543 | 805 | GGUGAGGGAGUGGUACCGCTsT | 806 | GCGGUACCACUCCCUCACCTsT | 108% | 8% |
| ND-10544 | 807 | AAAGUACACACAGCAGGUGTsT | 808 | CACCUGCUGUGUGUACUUUTsT | 140% | 7% |
| ND-10545 | 809 | CCAGGUUGACUUCUCCCATsT | 810 | UGAGGAGAAGUCAACCUGGTsT | 18% | 2% |
| ND-10546 | 811 | UGUUUCACCAAGUGCCGGATsT | 812 | UCCGGCACUUGGUGAAACATsT | 31% | 2% |
| ND-10547 | 813 | UGCUGGUUACUCACGAUGGTsT | 814 | CCAUUGUGAGUAACCAGCATsT | 144% | 10% |
| ND-10548 | 815 | UCCUCGGUGUUGUCUGUGGTsT | 816 | CCACAGACAACACCGAGGATsT | 106% | 14% |
| ND-10549 | 817 | AGGUAGCCUCCACCCUGGCTsT | 818 | GCCAGGGUGGAGGCUACCUTsT | 74% | 15% |
| ND-10550 | 819 | GCCGUUGAUGUGUGGAGGGTsT | 820 | CCCUCCACACAUCAACGGCTsT | 26% | 4% |
| ND-10551 | 821 | GAUGGGUAAGGGCUCAGGATsT | 822 | UCCUGAGCCCUUACCCAUCTsT | 22% | 1% |
| ND-10552 | 823 | CCCAACUGCGGCUAAGUCUTsT | 824 | AGACUUAGCCGCAGUUGGGTsT | 18% | 2% |
| ND-10553 | 825 | CCAAGCGAAACUUGGAGCUTsT | 826 | AGCUCCAAGUUUCGCUUGGTsT | 16% | 1% |
| ND-10554 | 827 | GGGUACACGCAGGCAUGCATsT | 828 | UGCAUGCCUGCGUGUACCCTsT | 19% | 2% |
| ND-10555 | 829 | UGCACGGGUUUCCUGCCCATsT | 830 | UGGGCAGGAAACCCGUGCATsT | 28% | 2% |
| ND-10556 | 831 | CUCCUCUAGCCUCAUACCCTsT | 832 | GGGUAUGAGGCUAGAGGAGTsT | 109% | 8% |
| ND-10557 | 833 | UCCUCUAGCCUCAUACCCGTsT | 834 | CGGGUAUGAGGCUAGAGGATsT | 117% | 7% |
| ND-10558 | 835 | UCUAGCCUCAUACCCGUGCTsT | 836 | GCACGGGUAUGAGGCUAGATsT | 128% | 9% |
| ND-10559 | 837 | UUCAUACCUCUACAUGUCUTsT | 838 | AGACAUGUAGAGGUAUGAATsT | 52% | 4% |
| ND-10560 | 839 | UCUACAUGUCUGCUUGAGATsT | 840 | UCUCAAGCAGACAUGUAGATsT | 15% | 2% |

TABLE 1B-continued

| | | | | | | |
|---|---|---|---|---|---|---|
| ND-10561 | 841 | AUAUUCCUCAGCCUGAAAUTsT | 842 | UUUCAGGCUGAGGAAAUAUTsT | 15% | 2% |
| ND-10562 | 843 | AACUCCUAUGCAUCCCUUAUTsT | 844 | UAAGGGAUGCAUAGGAGUUTsT | 14% | 1% |
| ND-10563 | 845 | GCAUCCCUUAGAACCCUGCTsT | 846 | GCAGGGUUCUAAGGGAUGCTsT | 20% | 1% |
| ND-10564 | 847 | UGAUCACUCCGCCUUCUCCTsT | 848 | GGAGAAGGCGGAGUGAUCATsT | 67% | 7% |
| ND-10565 | 849 | UGUAAGUGCCUUGCGGUCATsT | 850 | UGACCGCAAGGCACUUACATsT | 17% | 2% |
| ND-10566 | 851 | CCUUGCGGUCAGGGACUGATsT | 852 | UCAGUCCCUGACCGCAAGGTsT | 14% | 1% |
| ND-10567 | 853 | AAUCUUGCCCGUUUAUGUATsT | 854 | UACAUAAACGGGCAAGAUUTsT | 13% | 2% |
| ND-10568 | 855 | CCGUUUAUGUAUGCUCCAUTsT | 856 | AUGGAGCAUACAUAAACGGTsT | 19% | 6% |
| ND-10569 | 857 | UGUAUGCUCCAUGUCUAGCTsT | 858 | GCUAGACAUGGAGCAUACATsT | 87% | 13% |
| ND-10570 | 859 | CAUGUCUAGCCCAUCAUCCTsT | 860 | GGAUGAUGGGCUAGACAUGTsT | 33% | 4% |
| ND-10571 | 861 | AGUAGGCAGGAGCUCAAUATsT | 862 | UAUUGAGCUCCUGCCUACUTsT | 11% | 1% |
| ND-10572 | 863 | CCUACAGGUACCCGGAAAUTsT | 864 | AUUUCCGGGUACCUGUAGGTsT | 22% | 3% |
| ND-10573 | 865 | CCCGUCGAGCCCGUAGCGUTsT | 866 | ACGCUACGGGCUCGACGGGTsT | 23% | 1% |
| ND-10574 | 867 | GCGGUGAGGGAGUGGUACCTsT | 868 | GGUACCACUCCCUCACCGCTsT | 30% | 1% |
| ND-10575 | 869 | UUAUGGCGACUGCACCAAGTsT | 870 | CUUGGUGCAGUCGCCAUAATsT | 77% | 6% |
| ND-10576 | 871 | CUAUAAGCUCCAGGUUGACTsT | 872 | GUCAACCUGGAGCUUAUAGTsT | 11% | 1% |
| ND-10577 | 873 | UAUAAGCUCCAGGUUGACUTsT | 874 | AGUCAACCUGGAGCUUAUATsT | 42% | 8% |
| ND-10578 | 875 | AGGUUGACUUCUCCUCAGATsT | 876 | UCUGAGGAGAAGUCAACCUTsT | 13% | 3% |
| ND-10579 | 877 | CUGGGCUGUUUCACCAAGUTsT | 878 | ACUUGGUGAAACAGCCCAGTsT | 19% | 6% |
| ND-10580 | 879 | AACAAUUACACCGUCAACATsT | 880 | UGUUGACGGUGUAAUUGUUTsT | 13% | 1% |
| ND-10581 | 881 | UGGGUAAGGGCUCAGGAAGTsT | 882 | CUUCCUGAGCCCUUACCCATsT | 20% | 3% |
| ND-10582 | 883 | GGGUAAGGGCUCAGGAAGUTsT | 884 | ACUUCCUGAGCCCUUACCCTsT | 22% | 3% |
| ND-10583 | 885 | CACCCAACUGCGGCUAAGUTsT | 886 | ACUUAGCCGCAGUUGGGUGTsT | 22% | 10% |
| ND-10584 | 887 | ACCCAACUGCGGCUAAGUCTsT | 888 | GACUUAGCCGCAGUUGGGUTsT | 22% | 5% |
| ND-10585 | 889 | CCAACUGCGGCUAAGUCUCTsT | 890 | GAGACUUAGCCGCAGUUGGTsT | 14% | 2% |
| ND-10586 | 891 | CUUGGAUCAGCCAAGCGAATsT | 892 | UUCGCUUGGCUGAUCCAAGTsT | 15% | 1% |
| ND-10587 | 893 | GCCAAGCGAAACUUGGAGCTsT | 894 | GCUCCAAGUUUCGCUUGGCTsT | 17% | 2% |
| ND-10588 | 895 | UCCUAAGAAACCGCUGAUATsT | 896 | UAUCAGCGGUUUCUUAGGATsT | 11% | 2% |
| ND-10589 | 897 | GCAUGCACGGGUUUCCUGCTsT | 898 | GCAGGAAACCCGUGCAUGCTsT | 24% | 8% |
| ND-10590 | 899 | UGUUACUUAGGCAAUUCCCTsT | 900 | GGGAAUUGCCUAAGUAACATsT | 48% | 10% |
| ND-10591 | 901 | CUAGGGCUAGAGCAGACCCTsT | 902 | GGGUCUGCUCUAGCCCUAGTsT | 58% | 10% |
| ND-10592 | 903 | CUCUAGCCUCAUACCCGUGTsT | 904 | CACGGGUAUGAGGCUAGAGTsT | 34% | 5% |
| ND-10593 | 905 | UUAGAACCCUGCUCAGACATsT | 906 | UGUCUGAGCAGGGUUCUAATsT | 14% | 1% |
| ND-10594 | 907 | UGUGAACGCUUCUGCCACATsT | 908 | UGUGGCAGAAGCGUUCACATsT | 15% | 0% |
| ND-10595 | 909 | AUUGAUCACUCCGCCUUCUTsT | 910 | AGAAGGCGGAGUGAUCAAUTsT | 43% | 1% |
| ND-10596 | 911 | UCACUCCGCCUUCUCCUGGTsT | 912 | CCAGGAGAAGGCGGAGUGATsT | 90% | 5% |
| ND-10597 | 913 | GCGGUCAGGGACUGAAUCUTsT | 914 | AGAUUCAGUCCCUGACCGCTsT | 11% | 0% |
| ND-10598 | 915 | GGUCAGGGACUGAAUCUUGTsT | 916 | CAAGAUUCAGUCCCUGACCTsT | 13% | 1% |
| ND-10599 | 917 | GUAUGCUCCAUGUCUAGCCTsT | 918 | GGCUAGACAUGGAGCAUACTsT | 28% | 3% |
| ND-10600 | 919 | CCAUGUCUAGCCCAUCAUCTsT | 920 | GAUGAUGGGCUAGACAUGGTsT | 12% | 1% |

TABLE 1B-continued

| | | | | | |
|---|---|---|---|---|---|
| ND-10601 | 921 | GAUCGAGUUCCACCGCUCCTsT | 922 | GGAGCGGUGGAACUCGAUCTsT | 17% | 1% |
| ND-10602 | 923 | GGACUCUAGCCCUCCACAGTsT | 924 | CUGUGGAGGGCUAGAGUCCTsT | 41% | 4% |
| ND-10603 | 925 | UCACCACUCUCGUGGCCGGTsT | 926 | CCGGCCACGAGAGUGGUGATsT | 83% | 3% |
| ND-10604 | 927 | CAGCUUGCGGGACAACAACTsT | 928 | GUUGUUGUCCCGCAAGCUGTsT | 21% | 1% |
| ND-10605 | 929 | CAUCUUCUAUCCGCGGCCCTsT | 930 | GGGCCGCGGAUAGAAGAUGTsT | 26% | 2% |
| ND-10606 | 931 | AUAAGCUCCAGGUUGACUUTsT | 932 | AAGUCAACCUGGAGCUUAUTsT | 15% | 1% |
| ND-10607 | 933 | CUGCUGGUUACUCACGAUGTsT | 934 | CAUCGUGAGUAACCAGCAGTsT | 85% | 8% |
| ND-10608 | 935 | GAACAAUUACACCGUCAACTsT | 936 | GUUGACGGUGUAAUUGUUCTsT | 13% | 1% |
| ND-10609 | 937 | AUUACACCGUCAACAACAATsT | 938 | UUGUUGUUGACGGUGUAAUTsT | 12% | 0% |
| ND-10610 | 939 | CUGUGGUUCGGCUCCUCGGTsT | 940 | CCGAGGAGCCGAACCACAGTsT | 53% | 2% |
| ND-10611 | 941 | GAAGUGCCUUGGCUCCAGCTsT | 942 | GCUGGAGCCAAGGCACUUCTsT | 24% | 3% |
| ND-10612 | 943 | GAUCAGCCAAGCGAAACUUTsT | 944 | AAGUUUCGCUUGGCUGAUCTsT | 12% | 0% |
| ND-10613 | 945 | AGAAACCGCUGAUAACCAGTsT | 946 | CUGGUUAUCAGCGGUUUCUTsT | 12% | 1% |
| ND-10614 | 947 | UGAUAACCAGGACAAAACATsT | 948 | UGUUUUGUCCUGGUUAUCATsT | 7% | 1% |
| ND-10615 | 949 | CACGCAGGCAUGCACGGGUTsT | 950 | ACCCGUGCAUGCCUGCGUGTsT | 12% | 0% |
| ND-10616 | 951 | GCUCUCCAGUAGCACAGAUTsT | 952 | AUCUGUGCUACUGGAGAGCTsT | 9% | 0% |
| ND-10617 | 953 | CAGACCCGGGUAAGUAAAGTsT | 954 | CUUUACUUACCCGGGUCUGTsT | 55% | 3% |
| ND-10618 | 955 | AGACCCGGGUAAGUAAAGGTsT | 956 | CCUUUACUUACCCGGGUCUTsT | 72% | 8% |
| ND-10619 | 957 | AUCACUCCGCCUUCUCCUGTsT | 958 | CAGGAGAAGGCGGAGUGAUTsT | 63% | 6% |
| ND-10620 | 959 | CACUCCGCCUUCUCCUGGGTsT | 960 | CCCAGGAGAAGGCGGAGUGTsT | 28% | 1% |
| ND-10621 | 961 | AACUAGACUGUAAGUGCCUTsT | 962 | AGGCACUUACAGUCUAGUUTsT | 23% | 1% |
| ND-10622 | 963 | UAUGCUCCAUGUCUAGCCCTsT | 964 | GGGCUAGACAUGGAGCAUATsT | 98% | 2% |
| ND-10623 | 965 | CCCGAUGUAUGGAAACUGCTsT | 966 | GCAGUUUCCAUACAUCGGGTsT | 11% | 1% |
| ND-10624 | 967 | GUACUGCUACUAUAAGCUCTsT | 968 | GAGCUUAUAGUAGCAGUACTsT | 19% | 1% |
| ND-10625 | 969 | AGCGUGACCAGCUACCAGCTsT | 970 | GCUGGUAGCUGGUCACGCUTsT | 49% | 2% |
| ND-10626 | 971 | ACAAUUACACCGUCAACAATsT | 972 | UUGUUGACGGUGUAAUUGUTsT | 8% | 0% |
| ND-10627 | 973 | AUGCUCCUCUGGUGGGAGGTsT | 974 | CCUCCCACCAGAGGAGCAUTsT | 76% | 5% |
| ND-10628 | 975 | AACAGUAGCUGAUGAAGCUTsT | 976 | AGCUUCAUCAGCUACUGUUTsT | 22% | 1% |
| ND-10629 | 977 | CUGACUCCCGAGGGCUAGGTsT | 978 | CCUAGCCCUCGGGAGUCAGTsT | 34% | 2% |
| ND-10630 | 979 | GUGCAACCAGAACAAAUCGTsT | 980 | CGAUUUGUUCUGGUUGCACTsT | 10% | 1% |
| ND-10631 | 981 | UGCAACCAGAACAAAUCGGTsT | 982 | CCGAUUUGUUCUGGUUGCATsT | 48% | 4% |
| ND-10632 | 983 | CUUCAAAGUACACACAGCATsT | 984 | UGCUGUGUGUACUUUGAAGTsT | 20% | 1% |
| ND-10633 | 985 | CAGCGUGACCAGCUACCAGTsT | 986 | CUGGUAGCUGGUCACGCUGTsT | 35% | 1% |
| ND-10634 | 987 | AGAACAAUUACACCGUCAATsT | 988 | UUGACGGUGUAAUUGUUCUTsT | 14% | 0% |
| ND-10635 | 989 | GAUAACCAGGACAAAACACTsT | 990 | GUGUUUUGUCCUGGUUAUCTsT | 11% | 1% |
| ND-10636 | 991 | ACAACCAAGGGUACACGCATsT | 992 | UGCGUGUACCCUUGGUUGUTsT | 17% | 1% |
| ND-10637 | 993 | CCCAGCGACGGCUUAAGCCTsT | 994 | GGCUUAAGCCGUCGCUGGGTsT | 27% | 2% |
| ND-10638 | 995 | CUCCCGAGGGCUAGGGCUATsT | 996 | UAGCCCUAGCCCUCGGGAGTsT | 23% | 1% |
| ND-10639 | 997 | UAGAACCCUGCUCAGACACTsT | 998 | GUGUCUGAGCAGGGUUCUATsT | 35% | 2% |

TABLE 1B-continued

| | | | | | | | |
|---|---|---|---|---|---|---|---|
| ND-10640 | 999 | CCUGGGCUGUUUCACCAAGTsT | 1000 | CUUGGUGAAACAGCCCAGGTsT | 14% | 1% | | |
| ND-10641 | 1001 | GGAUCAGCCAAGCGAAACUTsT | 1002 | AGUUUCGCUUGGCUGAUCCTsT | 16% | 3% | | |
| ND-10642 | 1003 | AAGAAACCGCUGAUAACCATsT | 1004 | UGGUUAUCAGCGGUUUCUUTsT | 17% | 1% | | |
| ND-10643 | 1005 | ACCAAGGGUACACGCAGGCTsT | 1006 | GCCUGCGUGUACCCUUGGUTsT | 37% | 4% | | |
| ND-10644 | 1007 | GUAGCACAGAUGUCUGUCUTsT | 1008 | GAGCAGACAUCUGUGCUACTsT | 13% | 3% | | |
| ND-10645 | 1009 | UUUCAUACCUCUACAUGUCTsT | 1010 | GACAUGUAGAGGUAUGAAATsT | 88% | 8% | | |
| ND-10646 | 1011 | CCAACCAUCUGCCAGAGAATsT | 1012 | UUCUCUGGCAGAUGGUUGGTsT | 16% | 2% | | |
| ND-10647 | 1013 | GUCAGGGACUGAAUCUUGCTsT | 1014 | GCAAGAUUCAGUCCCUGACTsT | 16% | 3% | | |
| ND-10648 | 1015 | AGCAUGAUCAAGGAGUGUGTsT | 1016 | CACACUCCUUGAUCAUGCUTsT | 50% | 7% | | |
| ND-10649 | 1017 | GCAGCGUGACCAGCUACCATsT | 1018 | UGGUAGCUGGUCACGCUGCTsT | 40% | 6% | | |
| ND-10650 | 1019 | CAGCUCUCUGCUGGUUACUTsT | 1020 | AGUAACCGACAGAGAGCUGTsT | 56% | 5% | | |
| ND-10651 | 1021 | GUUCGGCUCCUCGGUGUUGTsT | 1022 | CAACACCGAGGAGCCGAACTsT | 68% | 5% | | |
| ND-10652 | 1023 | GCAGAUGCUCCUCUGGUGGTsT | 1024 | CCACCAGAGGAGCAUCUGCTsT | 26% | 5% | | |
| ND-10653 | 1025 | AGGAAGUUGCUCCAAGAACTsT | 1026 | GUUCUUGGAGCAACUUCCUTsT | 18% | 2% | | |
| ND-10654 | 1027 | AACGCUUCUGCCACAUCUUTsT | 1028 | AAGAUGUGGCAGAAGCGUUTsT | 18% | 1% | | |
| ND-10655 | 1029 | CACCUGGGCUGUUUCACCATsT | 1030 | UGGUGAAACAGCCCAGGUGTsT | 17% | 2% | | |
| ND-10656 | 1031 | AAGCCAUGCAGCGUGACCATsT | 1032 | UGGUCACGCUGCAUGGCUUTsT | 27% | 3% | | |
| ND-10657 | 1033 | CGAGGGCUAGGGCUAGAGCTsT | 1034 | GCUCUAGCCCUAGCCCUCGTsT | 30% | 1% | | |
| ND-10658 | 1035 | GGAAACCCUGGACAGACUUTsT | 1036 | AAGUCUGUCCAGGGUUUCCTsT | 14% | 1% | | |
| ND-10659 | 1037 | GUAGCUGAUGAAGCUGCCCTsT | 1038 | GGGCAGCUUCAUCAGCUACTsT | 19% | 1% | | |
| ND-10660 | 1039 | UCUUUUUCCCUUGGAUCAGTsT | 1040 | CUGAUCCAAGGGAAAAAGATsT | 88% | 4% | | |
| ND-10661 | 1041 | CUCCAGUAGCACAGAUGUCTsT | 1042 | GACAUCUGUGCUACUGGAGTsT | 10% | 1% | | |
| ND-10662 | 1043 | CCAAAAUUGAUCACUCCGCTsT | 1044 | GCGGAGUGAUCAAUUUUGGTsT | 25% | 3% | | |
| ND-10663 | 1045 | CAGACCACCUGGGCUGUUUTsT | 1046 | AAACAGCCCAGGUGGUCUGTsT | 24% | 2% | | |
| ND-10664 | 1047 | CCCUUCCCAACUAGACUGUTsT | 1048 | ACAGUCUAGUUGGGAAGGGTsT | 15% | 2% | | |
| ND-10665 | 1049 | CGCAGCCGUCGCGACCUGCTsT | 1050 | GCAGGUCGCGACGGCUGCGTsT | 45% | 2% | | |
| ND-10666 | 1051 | UUCUCACACCAAGGCAGAUTsT | 1052 | AUCUGCCUUGGUGUGAGAATsT | 25% | 2% | | |
| ND-10667 | 1053 | CACCACCAUCCACGCGCCUTsT | 1054 | GGCGCCGUGGAUGGUGGUGTsT | 35% | 3% | | |
| ND-10668 | 1055 | CCAUUACUUUUGUGAACGCTsT | 1056 | GCGUUCACAAAAGUAAUGGTsT | 19% | 4% | | |

| | | | | | | | 2nd screen single dose @ 50 nM in H441; MV | SD |
|---|---|---|---|---|---|---|---|---|
| ND-10669 | 1057 | CCAAGAACAGUAGCUGAUGTsT | 1058 | CAUCAGCUACUGUUCUUGGTsT | 23% | 4% | 16% | 2% |
| ND-10670 | 1059 | AGGAGAGGUUUCUCACACCTsT | 1060 | GGUGUGAGAAACCUCUCCUTsT | 18% | 3% | 17% | 1% |
| ND-10671 | 1061 | AUCAUCCUGCUUGGAGCAATsT | 1062 | UUGCUCCAAGCAGGAUGAUTsT | 33% | 3% | 24% | 2% |
| ND-10672 | 1063 | GCAUCACAGAGCAGACGCUTsT | 1064 | AGCGUCUGCUCUGUGAUGCTsT | 29% | 2% | 27% | 4% |
| ND-10673 | 1065 | AGGAGGUAGCCUCCACCCUTsT | 1066 | AGGGUGGAGGCUACCUCCUTsT | 63% | 6% | 61% | 3% |
| ND-10674 | 1067 | ACAACCGCAUGAAGACGGCTsT | 1068 | GCCGUCUUCAUGCGGUUGCTsT | 94% | 2% | | |
| ND-10675 | 1069 | GCAUGAAGACGGCCUUCUGTsT | 1070 | CAGAAGGCCGUCUUCAUGCTsT | 20% | 2% | 18% | 1% |
| ND-10676 | 1071 | GUCACGAUGGUCACCCUCCTsT | 1072 | GGAGGGUGACCAUCGUGACTsT | 66% | 5% | 60% | 4% |
| ND-10677 | 1073 | CCCUGCUCAGACACCAUUATsT | 1074 | UAAUGGUGUCUGAGCAGGGTsT | 15% | 3% | 18% | 1% |

TABLE 1B-continued

| | | | | | | | | |
|---|---|---|---|---|---|---|---|---|
| ND-10678 | 1075 | UCACGAUGGUCACCCUCCUTsT | 1076 | AGGAGGGUGACCAUCGUGATsT | 80% | 6% | 70% | 4% |
| ND-10679 | 1077 | UCAACCUCAACUCGGACAATsT | 1078 | UUGUCCGAGUUGAGGUUGATsT | 20% | 3% | 21% | 1% |
| ND-10680 | 1079 | UGACCAGCUACCAGCUCUCTsT | 1080 | GAGAGCUGGUAGCUGGUCATsT | 88% | 22% | 77% | 5% |
| ND-10681 | 1081 | GAUGGCCCUCGGUGACAUCTsT | 1082 | GAUGUCACCGAGGGCCAUCTsT | 88% | 18% | 60% | 4% |
| ND-10682 | 1083 | GCUUUGACAAGGAACUUUCTsT | 1084 | GAAAGUUCCUUGUCAAAGCTsT | 19% | 7% | 14% | 2% |
| ND-10683 | 1085 | CGAUACUGGUCUCCAGGCCTsT | 1086 | GGCCUGGAGACCAGUAUCGTsT | 27% | 5% | 27% | 2% |
| ND-10684 | 1087 | UCUGGAUGUCUUCCAUGCCTsT | 1088 | GGCAUGGAAGACAUCCAGATsT | 92% | 13% | 89% | 3% |
| ND-10685 | 1089 | CAGGACCCUAGACCUCUGCTsT | 1090 | GCAGAGGUCUAGGGUCCUGTsT | 58% | 14% | 50% | 2% |
| ND-10686 | 1091 | GACCCUAGACCUCUGCAGCTsT | 1092 | GCUGCAGAGGUCUAGGGUCTsT | 27% | 2% | | |
| ND-10687 | 1093 | ACCCUAGACCUCUGCAGCCTsT | 1094 | GGCUGCAGAGGUCUAGGGUTsT | 21% | 1% | | |
| ND-10688 | 1095 | CAGCCCACGGCGGAGGAGGTsT | 1096 | CCUCCUCCGCCGUGGGCUGTsT | 55% | 4% | | |
| ND-10689 | 1097 | CUCUUCGAGUUCUUCUGCATsT | 1098 | UGCAGAAGAACUCGAAGAGTsT | 13% | 3% | | |
| ND-10690 | 1099 | UUGGCAUGAUGUACUGGCATsT | 1100 | UGCCAGUACAUCAUGCCAATsT | 16% | 2% | | |
| ND-10691 | 1101 | GGCAUGAUGUACUGGCAAUTsT | 1102 | AUUGCCAGUACAUCAUGCCTsT | 13% | 1% | | |
| ND-10692 | 1103 | UGUACUGGCAAUUCGGCCUTsT | 1104 | AGGCCGAAUUGCCAGUACATsT | 45% | 2% | | |
| ND-10693 | 1105 | ACUGGCAAUUCGGCCUGCUTsT | 1106 | AGCAGGCCGAAUUGCCAGUTsT | 38% | 3% | | |
| ND-10694 | 1107 | GGCAAUUCGGCCUGCUUUUTsT | 1108 | AAAAGCAGGCCGAAUUGCCTsT | 10% | 1% | | |
| ND-10695 | 1109 | CAAUUCGGCCUGCUUUUCGTsT | 1110 | CGAAAAGCAGGCCGAAUUGTsT | 12% | 1% | | |
| ND-10696 | 1111 | UCGGAGAGUACUUCAGCUATsT | 1112 | UAGCUGAAGUACUCUCCGATsT | 12% | 1% | | |
| ND-10697 | 1113 | CAACAUCCUGUCGAGGCUGTsT | 1114 | CAGCCUCGACAGGAUGUUGTsT | 35% | 7% | | |
| ND-10698 | 1115 | CAUCCUGUCGAGGCUGCCATsT | 1116 | UGGCAGCCUCGACAGGAUGTsT | 26% | 6% | | |
| ND-10699 | 1117 | UCCUGCAACCAGGCGAAUUTsT | 1118 | AAUUCGCCUGGUUGCAGGATsT | 28% | 6% | | |
| ND-10700 | 1119 | GGAAACUGCUAUACUUUCATsT | 1120 | UGAAAGUAUAGCAGUUUCCTsT | 7% | 2% | | |
| ND-10701 | 1121 | ACGGUCUGUCCCUGAUGCUTsT | 1122 | AGCAUCAGGGACAGACCGUTsT | 28% | 7% | | |
| ND-10702 | 1123 | GGUCUGUCCCUGAUGCUGCTsT | 1124 | GCAGCAUCAGGGACAGACCTsT | 33% | 2% | | |
| ND-10703 | 1125 | GGCCCGGGUAAUGGUGCACTsT | 1126 | GUGCACCAUUACCCGGGCCTsT | 47% | 10% | | |
| ND-10704 | 1127 | CAGGAUGAACCUGCCUUUATsT | 1128 | UAAAGGCAGGUUCAUCCUGTsT | 59% | 2% | | |
| ND-10705 | 1129 | GAUGAACCUGCCUUUAUGGTsT | 1130 | CCAUAAAGGCAGGUUCAUCTsT | 77% | 7% | | |
| ND-10706 | 1131 | GGUGGCUUUAACUUGCGGCTsT | 1132 | GCCGCAAGUUAAAGCCACCTsT | 47% | 8% | | |
| ND-10707 | 1133 | GUGGCUUUAACUUGCGGCCTsT | 1134 | GGCCGCAAGUUAAAGCCACTsT | 17% | 2% | | |
| ND-10708 | 1135 | UUGCGGCCUGGCGUGGAGATsT | 1136 | UCUCCACGCCAGGCCGCAATsT | 52% | 3% | | |
| ND-10709 | 1137 | UGCGGCCUGGCGUGGAGACTsT | 1138 | GUCUCCACGCCAGGCCGCATsT | 81% | 4% | | |
| ND-10710 | 1139 | GCGGCCUGGCGUGGAGACCTsT | 1140 | GGUCUCCACGCCAGGCCGCTsT | 57% | 4% | | |
| ND-10711 | 1141 | CAGGUGUGUAUUCACUCCUTsT | 1142 | AGGAGUGAAUACACACCUGTsT | 24% | 2% | | |
| ND-10712 | 1143 | GUGUAUUCACUCCUGCUUCTsT | 1144 | GAAGCAGGAGUGAAUACACTsT | 20% | 1% | | |
| ND-10713 | 1145 | GGCCCUCGGUGACAUCCATsT | 1146 | UGGGAUGUCACCGAGGGCCTsT | 40% | 3% | | |
| ND-10714 | 1147 | GAUGCUAUCGCGACAGAACTsT | 1148 | GUUCUGUCGCGAUAGCAUCTsT | 24% | 2% | | |
| ND-10715 | 1149 | ACUACAAAACCAAUUCUGATsT | 1150 | UCAGAAUUGGUUUUGUAGUTsT | 19% | 2% | | |
| ND-10716 | 1151 | CAAUUCUGAGUCUCCCUCUTsT | 1152 | AGAGGGAGACUCAGAAUUGTsT | 35% | 3% | | |

TABLE 1B-continued

| | | | | | | |
|---|---|---|---|---|---|---|
| ND-10717 | 1153 | CUCUGUCACGAUGGUCACCUsT | 1154 | GGUGACCAUCGUGACAGAGTsT | 41% | 4% |
| ND-10718 | 1155 | CUGCUCCGAAGGUUCCGAAUsT | 1156 | UUCGGAACCUUCGGAGCAGTsT | 16% | 3% |
| ND-10719 | 1157 | AGGUUCCGAAGCCGAUACUTsT | 1158 | AGUAUCGGCUUCGGAACCUTsT | 16% | 2% |
| ND-10720 | 1159 | GUUCCGAAGCCGAUACUGGTsT | 1160 | CCAGUAUCGGCUUCGGAACTsT | 21% | 2% |
| ND-10721 | 1161 | CGAAGCCGAUACUGGUCUCTsT | 1162 | GAGACCAGUAUCGGCUUCGTsT | 16% | 1% |
| ND-10722 | 1163 | AAGAUUGAAGGAUGUGCAGTsT | 1164 | CUGCACAUCCUUCAAUCUUTsT | 25% | 2% |
| ND-10723 | 1165 | GAUUGAAGGAUGUGCAGGGTsT | 1166 | CCCUGCACAUCCUUCAAUCTsT | 26% | 1% |
| ND-10724 | 1167 | UGCCUCUGAACACUCUGGUTsT | 1168 | ACCAGAGUGUUCAGAGGCATsT | 45% | 3% |
| ND-10725 | 1169 | CCUCUGAACACUCUGGUUUTsT | 1170 | AAACCAGAGUGUUCAGAGGTsT | 15% | 2% |
| ND-10726 | 1171 | GACAAGGAACUUUCCUAAGTsT | 1172 | CUUAGGAAAGUUCCUUGUCTsT | 105% | 14% |
| ND-10727 | 1173 | CAGGACAAAACACAACCAATsT | 1174 | UUGGUUGUGUUUUGUCCUGTsT | 32% | 5% |
| ND-10728 | 1175 | AACACAACCAAGGGUACACTsT | 1176 | GUGUACCCUUGGUUGUGUUTsT | 60% | 13% |
| ND-10729 | 1177 | UUGAACUUGGGUGGGAAACTsT | 1178 | GUUUCCCACCCAAGUUCAATsT | 23% | 8% |
| ND-10730 | 1179 | UGAACUUGGGUGGGAAACCTsT | 1180 | GGUUUCCCACCCAAGUUCATsT | 18% | 4% |
| ND-10731 | 1181 | ACCCGUGCCCUCACAGAGCTsT | 1182 | GCUCUGUGAGGGCACGGGUTsT | 19% | 1% |
| ND-10732 | 1183 | ACUAUAACAUCGCUGGAGTsT | 1184 | CUCCAGCAGAUGUUAUAGUTsT | 17% | 5% |
| ND-10733 | 1185 | AUCUGCUGGAGUGUUGCUGTsT | 1186 | CAGCAACACUCCAGCAGAUTsT | 119% | 20% |
| ND-10734 | 1187 | CUGCUGGAGUGUUGCUGUUTsT | 1188 | AACAGCAACACUCCAGCAGTsT | 58% | 13% |
| ND-10735 | 1189 | CUAGCCCAUCAUCCUGCUUTsT | 1190 | AAGCAGGAUGAUGGGCUAGTsT | 20% | 6% |
| ND-10736 | 1191 | CUCUGGAUGUCUUCCAUGCTsT | 1192 | GCAUGGAAGACAUCCAGAGTsT | 28% | 8% |
| ND-10737 | 1193 | AGCAGGACCCUAGACCUCUTsT | 1194 | AGAGGUCUAGGGUCCUGCUTsT | 36% | 2% |
| ND-10738 | 1195 | UUCGAGUUCUUCUGCAACATsT | 1196 | UGUUGCAGAAGAACUCGAATsT | 13% | 1% |
| ND-10739 | 1197 | CACCAUCCACGGCGCCAUCTsT | 1198 | GAUGGCGCCGUGGAUGGUGTsT | 13% | 2% |
| ND-10740 | 1199 | CCACGGCGCCAUCCGCCUGTsT | 1200 | CAGGCGGAUGGCGCCGUGGTsT | 44% | 4% |
| ND-10741 | 1201 | CAGCACAACCGCAUGAAGATsT | 1202 | UCUUCAUGCGGUUGUGCUGTsT | 23% | 3% |
| ND-10742 | 1203 | CCUUUGGCAUGAUGUACUGTsT | 1204 | CAGUACAUCAUGCCAAAGGTsT | 12% | 1% |
| ND-10743 | 1205 | AUCCUGCUGAGGCUGCCAGTsT | 1206 | CUGGCAGCCUCGACAGGAUTsT | 14% | 3% |
| ND-10744 | 1207 | UCUCCUGCAACCAGGCGAATsT | 1208 | UUCGCCUGGUUGCAGGAGATsT | 12% | 1% |
| ND-10745 | 1209 | UGCAACCAGGCGAAUUACUTsT | 1210 | AGUAAUUCGCCUGGUUGCATsT | 45% | 5% |
| ND-10746 | 1211 | ACCUCCAUCAGCAUGAGGATsT | 1212 | UCCUCAUGCUGAUGGAGGUTsT | 82% | 7% |
| ND-10747 | 1213 | GCGACUGCACCAAGAAUGGTsT | 1214 | CCAUUCUUGGUGCAGUCGCTsT | 82% | 19% |
| ND-10748 | 1215 | ACCAAGAAUGGCAGUGAUGTsT | 1216 | CAUCACUGCCAUUCUUGGUTsT | 54% | 18% |
| ND-10749 | 1217 | UGGUUACUCACGAUGGCCCTsT | 1218 | GGGCCAUCGUGAGUAACCATsT | 45% | 7% |
| ND-10750 | 1219 | AGAAAUGGAGUGGCCAAAGTsT | 1220 | CUUUGGCCACUCCAUUUCUTsT | 11% | 3% |
| ND-10751 | 1221 | GGAGCUGAACUACAAAACCTsT | 1222 | GGUUUUGUAGUUCAGCUCCTsT | 15% | 3% |
| ND-10752 | 1223 | CCUCUGUCACGAUGGUCACTsT | 1224 | GUGACCAUCGUGACAGAGGTsT | 18% | 5% |
| ND-10753 | 1225 | AGAUUGAAGGAUGUGCAGGTsT | 1226 | CCUGCACAUCCUUCAAUCUTsT | 26% | 3% |
| ND-10754 | 1227 | GAGCUUUGACAAGGAACUUTsT | 1228 | AAGUUCCUUGUCAAAGCUCTsT | 14% | 2% |
| ND-10755 | 1229 | CUUUGACAAGGAACUUUCCTsT | 1230 | GGAAAGUUCCUUGUCAAAGTsT | 50% | 8% |
| ND-10756 | 1231 | UCAGACACCAUUACUUUUGTsT | 1232 | CAAAAGUAAUGGUGUCUGATsT | 32% | 4% |

TABLE 1B-continued

| | | | | | |
|---|---|---|---|---|---|
| ND-10757 | 1233 | AGCACACUAUAACAUCUGCTsT | 1234 | GCAGAUGUUAUAGUGUGCUTsT | 11% | 2% |
| ND-10758 | 1235 | GCACAACCGCAUGAAGACGTsT | 1236 | CGUCUUCAUGCGGUUGUGCTsT | 34% | 3% |
| ND-10759 | 1237 | ACUGCUUCUACCAGACAUATsT | 1238 | UAUGUCUGGUAGAAGCAGUTsT | 11% | 1% |
| ND-10760 | 1239 | GAAGACGGCCUUCUGGGCATsT | 1240 | UGCCCAGAAGGCCGUCUUCTsT | 16% | 2% |
| ND-10761 | 1241 | AAGACGGCCUUCUGGGCAGTsT | 1242 | CUGCCCAGAAGGCCGUCUUTsT | 58% | 21% |
| ND-10762 | 1243 | ACAUCAACCUCAACUCGGATsT | 1244 | UCCGAGUUGAGGUUGAUGUTsT | 14% | 3% |
| ND-10763 | 1245 | UGGAAGGACUGGAAGAUCGTsT | 1246 | CGAUCUUCCAGUCCUUCCATsT | 109% | 29% |
| ND-10764 | 1247 | ACAUCCUGUCGAGGCUGCCTsT | 1248 | GGCAGCCUCGACAGGAUGUTsT | 101% | 13% |
| ND-10765 | 1249 | CAACCAGGCGAAUUACUCUTsT | 1250 | AGAGUAAUUCGCCUGGUUGTsT | 19% | 5% |
| ND-10766 | 1251 | CAGGCGAAUUACUCUCACUTsT | 1252 | AGUGAGAGUAAUUCGCCUGTsT | 24% | 4% |
| ND-10767 | 1253 | AGCAGAAUGACUUCAUUCCTsT | 1254 | GGAAUGAAGUCAUUCUGCTsT | 40% | 8% |
| ND-10768 | 1255 | AUGAUGGUGGCUUUAACUUTsT | 1256 | AAGUUAAAGCCACCAUCAUTsT | 85% | 8% |
| ND-10769 | 1257 | AGAACCUUUACCCUUCAAATsT | 1258 | UUUGAAGGGUAAAGGUUCTsT | 22% | 4% |
| ND-10770 | 1259 | CCUUUACCCUUCAAAGUACTsT | 1260 | GUACUUUGAAGGGUAAAGGTsT | 21% | 4% |
| ND-10771 | 1261 | GAGCCUGUGGUUCGGCUCCTsT | 1262 | GGAGCCGAACCACAGGCUCTsT | 28% | 1% |
| ND-10772 | 1263 | UGGUACUGCCUCUGAACACTsT | 1264 | GUGUUCAGAGGCAGUACCATsT | 58% | 4% |
| ND-10773 | 1265 | CUCAUACCCGUGCCCUCACTsT | 1266 | GUGAGGGCACGGGUAUGAGTsT | 15% | 2% |
| ND-10774 | 1267 | CCGUAGCACACUAUAACAUTsT | 1268 | AUGUUAUAGUGUGCUACGGTsT | 24% | 6% |
| ND-10775 | 1269 | CGUAGCACACUAUAACAUCTsT | 1270 | GAUGUUAUAGUGUGCUACGTsT | 21% | 4% |
| ND-10776 | 1271 | GCAGGACCCUAGACCUCUGTsT | 1272 | CAGAGGUCUAGGGUCCUGCTsT | 25% | 4% |
| ND-10777 | 1273 | GCCUGCUUUUCGGAGAGUATsT | 1274 | UACUCUCCGAAAAGCAGGCTsT | 18% | 4% |
| ND-10778 | 1275 | GGGCCCGGGUAAUGGUGCATsT | 1276 | UGCACCAUUACCCGGGCCCTsT | 16% | 2% |
| ND-10779 | 1277 | CAACAACAAGAGAAAUGGATsT | 1278 | UCCAUUUCUCUUGUUGUUGTsT | 17% | 0% |
| ND-10780 | 1279 | GCUGUUGCACCAUACUUUCTsT | 1280 | GAAAGUAUGGUGCAACAGCTsT | 14% | 1% |
| ND-10781 | 1281 | CUACCGAGAGCUCUUCGAGTsT | 1282 | CUCGAAGAGCUCUCGGUAGTsT | 24% | 3% |
| ND-10782 | 1283 | ACCUGCCUUUAUGGAUGAUTsT | 1284 | AUCAUCCAUAAAGGCAGGUTsT | 115% | 10% |
| ND-10783 | 1285 | UUGACAAGGAACUUCCUATsT | 1286 | UAGGAAAGUUCCUUGUCAATsT | 16% | 1% |
| ND-10784 | 1287 | GCUGGAGUGUUGCUGUUGCTsT | 1288 | GCAACAGCAACACUCCAGCTsT | 12% | 1% |
| ND-10785 | 1289 | UCGGUGACAUCCCAGGAAUTsT | 1290 | AUUCCUGGGAUGUCACCGATsT | 28% | 1% |
| ND-10786 | 1291 | GCUGCCCAGAAGUGCCUUGTsT | 1292 | CAAGGCACUUCUGGGCAGCTsT | 15% | 2% |
| ND-10787 | 1293 | AGUACACACAGCAGGUGUGTsT | 1294 | CACACCUGCUGUGUGUACUTsT | 12% | 1% |
| ND-10788 | 1295 | CAAGUGCCGGAAGCCAUGCTsT | 1296 | GCAUGGCUUCCGGCACUUGTsT | 94% | 2% |

Table 1C: Selected siRNAs in in vivo rat surrogate set (human-rat cross-reactive siRNAs with highest specificity in rat). A screening set of 48 human and rat cross-reactive alpha-ENaC iRNA sequences were identified. The percentage residual expression of alpha-ENaC in two independent single-dose transfection experiments is shown (refer to examples section for methods used).

TABLE 1C

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-9201 | 1297 | uGuGcAAccAGAAcAAAucTsT | 1298 | GAUUUGUUCUGGUUGcAcATsT | 80% | 1% | 8% | 1% |
| ND-9202 | 1299 | uuuAuGGAuGAuGGuGGcuTsT | 1300 | AGCcACcAUcAUCcAuAAATsT | 80% | 9% | 82% | 6% |
| ND-9203 | 1301 | GccuuuAuGGAuGAuGGuTsT | 1302 | cACcAUcAUCcAuAAAGGCTsT | 76% | 8% | 76% | 2% |
| ND-9204 | 1303 | cAcAAccGcAuGAAGAcGGTsT | 1304 | CCGUCUUcAUGCGGUUGUGTsT | 73% | 18% | 57% | 3% |
| ND-9205 | 1305 | AccGcAuGAAGAcGGccuuTsT | 1306 | AAGGCCGUCUUcAUGCGGUTsT | 35% | 3% | 37% | 2% |
| ND-9206 | 1307 | AGGAcuGGAAGAucGGcuuTsT | 1308 | AAGCCGAUCUUCcAGUCCUTsT | 17% | 3% | 16% | 3% |
| ND-9207 | 1309 | GAAGGAcuGGAAGAucGGcTsT | 1310 | GCCGAUCUUCcAGUCCUUCTsT | 96% | 18% | 81% | 5% |
| ND-9208 | 1311 | GGAcuGGAAGAucGGcuucTsT | 1312 | GAAGCCGAUCUUCcAGUCCTsT | 58% | 6% | 57% | 3% |
| ND-9209 | 1313 | AGuuccAccGcuccuAccGTsT | 1314 | CGGuAGGAGCGGUGGAACUTsT | 85% | 8% | 94% | 4% |
| ND-9210 | 1315 | GAcuGGAAGAucGGcuuccTsT | 1316 | GGAAGCCGAUCUUCcAGUCTsT | 79% | 5% | 82% | 2% |
| ND-9211 | 1317 | cGcAuGAAGAcGccuuucuTsT | 1318 | AGAAGGCCGUCUUcAUGCGTsT | 50% | 1% | 51% | 1% |
| ND-9212 | 1319 | GccAGuGGAGccuGuGGuuTsT | 1320 | AACcAcAGGCUCcACUGGCTsT | 26% | 3% | 23% | 2% |
| ND-9213 | 1321 | uGccuuuAuGGAuGAuGGuTsT | 1322 | ACcAUcAUCcAuAAAGGcATsT | 77% | 5% | 76% | 4% |
| ND-9214 | 1323 | uccuGuccAAccuGGGcAGTsT | 1324 | CUGCCcAGGUUGGAcAGGATsT | 74% | 9% | 83% | 6% |
| ND-9215 | 1325 | AGGGAGuGGuAccGcuccTsT | 1326 | GGAAGCGGuAccACUCCCUTsT | 79% | 6% | 89% | 4% |
| ND-9216 | 1327 | GGcuGuGccuAcAucuucuTsT | 1328 | AGAAGAUGuAGGcAcAGCCTsT | 11% | 1% | 13% | 1% |
| ND-9217 | 1329 | GAAAuuAAAGAGGAGcuGGTsT | 1330 | CcAGCUCCUCUUuAAUUUCTsT | 84% | 14% | 78% | 5% |
| ND-9218 | 1331 | AcuGGAAGAucGGcuuccATsT | 1332 | UGGAAGCCGAUCUUCcAGUTsT | 50% | 4% | 55% | 3% |
| ND-9219 | 1333 | ccuGuccAAccuGGGcAGTsT | 1334 | GCUGCCcAGGUUGGAcAGGTsT | 78% | 6% | 85% | 5% |
| ND-9220 | 1335 | ccuGccuuuAuGGAuGAuGTsT | 1336 | cAUcAUCcAuAAAGGcAGGTsT | 76% | 5% | 77% | 9% |
| ND-9221 | 1337 | AAccGcAuGAAGAcGGccuTsT | 1338 | AGGCCGUCUUcAUGCGGUUTsT | 79% | 8% | 66% | 3% |
| ND-9222 | 1339 | uGuccAAccuGGGcAGccATsT | 1340 | UGGCUGCCcAGGUUGGAcATsT | 70% | 4% | 57% | 4% |
| ND-9223 | 1341 | GuccAAccuGGGcAGccAGTsT | 1342 | CUGGCUGUUcAGGUUGGACTsT | 95% | 10% | 76% | 4% |
| ND-9224 | 1343 | AAAuuAAAGAGGAGcuGGATsT | 1344 | UCcAGCUCCUCUUuAAUUUTsT | 83% | 6% | 69% | 2% |
| ND-9225 | 1345 | GGAAGGAcuGGAAGAucGGTsT | 1346 | CCGAUCUUCcAGUCCUUCCTsT | 41% | 2% | 30% | 2% |
| ND-9226 | 1347 | GuGAGGGAGuGGuAccGcuTsT | 1348 | AGCGGuAccACUCCCUcACTsT | 21% | 1% | 17% | 0% |
| ND-9227 | 1349 | AcuuucAAuGAcAAGAAcATsT | 1350 | UGUUCUUGUcAUUGAAAGUTsT | 13% | 1% | 10% | 0% |
| ND-9228 | 1351 | ucAAuGAcAAGAAcAAcucTsT | 1352 | GAGUUGUUCUUGUcAUUGATsT | 36% | 2% | 28% | 0% |
| ND-9229 | 1353 | cuuuAuGGAuGAuGGuGGcTsT | 1354 | GCcACcAUcAUCcAuAAAGTsT | 24% | 1% | 20% | 1% |
| ND-9230 | 1355 | GccuGGcGuGGAGAccuccTsT | 1356 | GGAGGUCUCcACGCcAGGCTsT | | | | |
| ND-9231 | 1357 | uGGcGuGGAGAccuccAucTsT | 1358 | GAUGGAGGUCUCcACGCcATsT | 45% | 4% | 35% | 3% |
| ND-9232 | 1359 | GAGuuccAccGcuccuAccTsT | 1360 | GGuAGGAGCGGUGGAACUCTsT | 89% | 4% | 86% | 8% |
| ND-9233 | 1361 | cAGAGcAGAAuGAcuucAuTsT | 1362 | AUGAAGUcAUUCUGCUCUGTsT | 21% | 1% | 17% | 0% |
| ND-9234 | 1363 | uucAcuccuGcuuccAGGATsT | 1364 | UCCUGGAAGcAGGAGUGAATsT | 85% | 4% | 74% | 6% |
| ND-9235 | 1365 | ucAcuccuGcuuccAGGAGTsT | 1366 | CUCCUGGAAGcAGGAGUGATsT | | | | |
| ND-9236 | 1367 | cuGuGcAAccAGAAcAAAuTsT | 1368 | AUUUGUUCUGGUUGcAcAGTsT | 23% | 1% | 17% | 2% |
| ND-9237 | 1369 | cuGcAAcAAcAccAccAucTsT | 1370 | GAUGGUGGUGUUGUUGcAGTsT | 34% | 2% | 27% | 2% |

TABLE 1C-continued

| Duplex ID | Seq ID | Sense | Seq ID | Antisense | 1st screen single dose @ 50 nM in H441; MV | SD | 2nd screen @ 50 nM in H441 | SD |
|---|---|---|---|---|---|---|---|---|
| ND-9238 | 1371 | uGuGGcuGuGccuAcAucuTsT | 1372 | AGAUGuAGGcAcAGCcAcATsT | 86% | 4% | 73% | 10% |
| ND-9239 | 1373 | uGGcuGuGccuAcAucuucTsT | 1374 | GAAGAUGuAGGcAcAGCcATsT | 68% | 6% | 53% | 4% |
| ND-9240 | 1375 | cuGuccAAccuGGGcAGccTsT | 1376 | GGCUGCCcAGGUUGGAcAGTsT | 80% | 5% | 73% | 9% |
| ND-9241 | 1377 | cccuGcuGuccAcAGuGAcTsT | 1378 | GUcACUGUGGAcAGcAGGGTsT | 83% | 5% | 71% | 5% |
| ND-9242 | 1379 | GcAGccAGuGGAGccuGuGTsT | 1380 | cAcAGGCUCcACUGGCUGCTsT | 105% | 9% | 90% | 5% |
| ND-9243 | 1381 | uucAAuGAcAAGAAcAAcuTsT | 1382 | AGUUGUUCUUGUcAUUGAATsT | 23% | 3% | 21% | 1% |
| ND-9244 | 1383 | cuGccuuuAuGGAuGAuGGTsT | 1384 | CcAUcAUCcAuAAAGGcAGTsT | 74% | 6% | 64% | 7% |
| ND-9245 | 1385 | AAuGAcAAGAAcAAcuccATsT | 1386 | UGGAGUUGUUCUUGUcAUUTsT | 21% | 1% | 21% | 1% |
| ND-9246 | 1387 | uGGGcAGccAGuGGAGccuTsT | 1388 | AGGCUCcACUGGCUGCCcATsT | 83% | 3% | 73% | 2% |
| ND-9247 | 1389 | cuccuGuccAAccuGGGcATsT | 1390 | UGCCcAGGUUGGAcAGGAGTsT | 86% | 3% | 84% | 1% |
| ND-9248 | 1391 | GGcGuGGAGAccuccAucATsT | 1392 | UGAUGGAGGUCUCcACGCCTsT | 92% | 4% | 88% | 3% |

Table 1D: Selected siRNAs in vivo guinea pig surrogate set (human-guinea pig cross-reactive siRNAs). A screening set of 63 human and guinea-pig cross-reactive alpha-ENaC iRNA sequences were identified and synthesised, both with (sequence strands 1393-1518) and without (sequence strands 1519-16) backbone modification. The percentage residual expression of alpha-ENaC in two independent single-dose transfection experiments is shown (refer to examples section for methods used).

TABLE 1D

| Duplex ID | Seq ID | Sense | Seq ID | Antisense | 1st screen single dose 50 nM in H441; MV | SD | 2nd screen @ 50 nM in H441 | SD |
|---|---|---|---|---|---|---|---|---|
| ND8437 | 1393 | AAucGGAcuGcuucuAccATsT | 1394 | UGGuAGAAGcAGUCCGAUUTsT | 48% | 7% | 46% | 5% |
| ND8438 | 1395 | AucGGAcuGcuucuAccAGTsT | 1396 | CUGGuAGAAGcAGUCCGAUTsT | 85% | 5% | 93% | 13% |
| ND8439 | 1397 | AAAucGGAcuGcuucuAccTsT | 1398 | GGuAGAAGcAGUCCGAUUUTsT | 36% | 3% | 42% | 6% |
| ND8440 | 1399 | ucGGAcuGcuucuAccAGATsT | 1400 | UCUGGuAGAAGcAGUCCGATsT | 45% | 3% | 50% | 4% |
| ND8441 | 1401 | AccAGAAcAAAucGGAcuGTsT | 1402 | cAGUCCGAUUUGUUCUGGUTsT | 23% | 3% | 24% | 6% |
| ND8442 | 1403 | ccAGAAcAAAucGGAcuGcTsT | 1404 | GcAGUCCGAUUUGUUCUGGTsT | 50% | 6% | 39% | 9% |
| ND8443 | 1405 | cAGAAcAAAucGGAcuGcuTsT | 1406 | AGcAGUCCGAUUUGUUCUGTsT | 22% | 2% | 24% | 1% |
| ND8444 | 1407 | cuucGccuGccGcuucAAcTsT | 1408 | GUUGAAGCGGcAGGCGAAGTsT | 111% | 8% | 109% | 4% |
| ND8445 | 1409 | uGGuAccGcuuccAcuAcATsT | 1410 | UGuAGUGGAAGCGGuACCATsT | 84% | 7% | 97% | 13% |
| ND8446 | 1411 | AucuucGccuGccGccucATsT | 1412 | UGAAGCGGcAGGCGAAGAUTsT | 90% | 3% | 121% | 13% |
| ND8447 | 1413 | uucGccuGccGcuucAAccTsT | 1414 | GGUUGAAGCGGcAGGCGAATsT | 92% | 2% | 105% | 17% |
| ND8448 | 1415 | cAcccucAAucccuAcAGGTsT | 1416 | CCUGuAGGGAUUGAGGGUGTsT | 79% | 3% | 90% | 13% |
| ND8449 | 1417 | AGAAcAAAucGGAcuGcuuTsT | 1418 | AAGcAGUCCGAUUUGUUCUTsT | 11% | 0% | 17% | 3% |
| ND8450 | 1419 | GAAcAAAucGGAcuGcuucTsT | 1420 | GAAGcAGUCCGAUUUGUUCTsT | 21% | 1% | 30% | 5% |
| ND8451 | 1421 | cGGAcuGcuucuAccAGAcTsT | 1422 | GUCUGGuAGAAGcAGUCCGTsT | 24% | 2% | 32% | 5% |
| ND8452 | 1423 | AGcccuAAcAucAAccucATsT | 1424 | UGAGGUUGAUGUUGAGGCUTsT | 51% | 3% | 57% | 4% |
| ND8453 | 1425 | GcccucAAcAucAAccucAATsT | 1426 | UUGAGGUUGAUGUUGAGGCTsT | 16% | 1% | 26% | 3% |

TABLE 1D-continued

| Duplex ID | Seq ID | Sense | Seq ID | Antisense | 1st screen single dose 50 nM in H441; MV | SD | 2nd screen @ 50 nM in H441 | SD |
|---|---|---|---|---|---|---|---|---|
| ND8454 | 1427 | GucAGccucAAcAucAAccTsT | 1428 | GGUUGAUGUUGAGGCUGACTsT | 62% | 5% | 68% | 6% |
| ND8455 | 1429 | ucAGccucAAcAucAAccuTsT | 1430 | AGGUUGAUGUUGAGGCUGATsT | 77% | 4% | 87% | 6% |
| ND8456 | 1431 | cAGccucAAcAucAAccucTsT | 1432 | GAGGUUGAUGUUGAGGCUGTsT | 34% | 2% | 51% | 8% |
| ND8457 | 1433 | GGAGcuGGAccGcAucAcATsT | 1434 | UGUGAUGCGGUCcAGCUCCTsT | 26% | 2% | 17% | 1% |
| ND8458 | 1435 | GuAccGcuuccAcuAcAucTsT | 1436 | GAUGuAGUGGAAGCGGuACTsT | 101% | 9% | 99% | 11% |
| ND8459 | 1437 | ccGcuuccAcuAcAucAAcTsT | 1438 | GUUGAUGuAGUGGAAGCGGTsT | 85% | 8% | 80% | 6% |
| ND8460 | 1439 | cGcuuccAcuAcAucAATsT | 1440 | UGUUGAUGuAGUGGAAGCGTsT | 56% | 6% | 48% | 3% |
| ND8461 | 1441 | uuccAcuAcAucAAcAuccTsT | 1442 | GGAUGUUGAUGuAGUGGAATsT | 77% | 5% | 82% | 7% |
| ND8462 | 1443 | uGGGcAAcuucAucuucGcTsT | 1444 | GCGAAGAUGAAGUUGCCcATsT | 21% | 0% | 36% | 6% |
| ND8463 | 1445 | GcAAcuucAucuucGccuGTsT | 1446 | cAGGCGAAGAUGAAGUUGCTsT | 80% | 4% | 84% | 13% |
| ND8464 | 1447 | cAAcuucAucuucGccuGcTsT | 1448 | GcAGGCGAAGAUGAAGUUGTsT | 101% | 1% | 102% | 14% |
| ND8465 | 1449 | AAcuucAucuucGccuGccTsT | 1450 | GGcAGGCGAAGAUGAAGUUTsT | 100% | 4% | 95% | 12% |
| ND8466 | 1451 | AcuucAucuucGccuGccGTsT | 1452 | CGGcAGGCGAAGAUGAAGUTsT | 51% | 4% | 49% | 5% |
| ND8467 | 1453 | cuucAucuucGccuGccGcTsT | 1454 | GCGGcAGGCGAAGAUGAAGTsT | 95% | 5% | 89% | 4% |
| ND8468 | 1455 | ucAucuucGccuGccGcuuTsT | 1456 | AAGCGGcAGGCGAAGAUGATsT | 91% | 4% | 85% | 6% |
| ND8469 | 1457 | cAucuucGccuGccGcuucTsT | 1458 | GAAGCGGcAGGCGAAGAUGTsT | 66% | 4% | 55% | 4% |
| ND8470 | 1459 | ucuucGccuGccGcuucAATsT | 1460 | UUGAAGCGGcAGGCGAAGATsT | 97% | 2% | 99% | 11% |
| ND8471 | 1461 | cGccuGccGcuucAAccAGTsT | 1462 | CUGGUUGAAGCGGcAGGCGTsT | 96% | 4% | 100% | 7% |
| ND8472 | 1463 | GccuGccGcuucAAccAGGTsT | 1464 | CCUGGUUGAAGCGGcAGGCTsT | 90% | 4% | 82% | 5% |
| ND8473 | 1465 | AuuAcucucAcuuccAccATsT | 1466 | UGGUGGAAGUGAGAGuAAUTsT | 81% | 3% | 72% | 4% |
| ND8474 | 1467 | uuAcucucAcuuccAccAcTsT | 1468 | GUGGUGGAAGUGAGAGuAATsT | 72% | 2% | 76% | 9% |
| ND8475 | 1469 | AcucucAcuuccAccAcccTsT | 1470 | GGGUGGUGGAAGUGAGAGUTsT | 90% | 3% | 97% | 4% |
| ND8476 | 1471 | ucuGcAcccucAAucccuATsT | 1472 | uAGGGAUUGAGGGUGcAGATsT | 61% | 1% | 63% | 3% |
| ND8477 | 1473 | cuGcAcccucAAucccuAcTsT | 1474 | GuAGGGAUUGAGGGUGcAGTsT | 74% | 3% | 73% | 1% |
| ND8478 | 1475 | uGcAcccucAAucccuAcATsT | 1476 | UGuAGGGAUUGAGGGUGcATsT | 98% | 4% | 85% | 1% |
| ND8479 | 1477 | AcccucAAucccuAcAGGuTsT | 1478 | ACCUGuAGGGAUUGAGGGUTsT | 55% | 5% | 48% | 3% |
| ND8480 | 1479 | cccucAAucccuAcAGGuATsT | 1480 | uACCUGuAGGGAUUGAGGGTsT | 20% | 1% | 14% | 1% |
| ND8481 | 1481 | ccucAAucccuAcAGGuAcTsT | 1482 | GuACCUGuAGGGAUUGAGGTsT | 40% | 2% | 31% | 3% |
| ND8482 | 1483 | AAccAGAAcAAAucGGAcuTsT | 1484 | AGUCCGAUUUGUUCUGGUUTsT | 57% | 2% | 52% | 0% |
| ND8483 | 1485 | AAcAAAucGGAcuGcuucuTsT | 1486 | AGAAGcAGUCCGAUUUGUUTsT | 102% | 5% | 86% | 12% |
| ND8484 | 1487 | AcAAAucGGAcuGcuucATsT | 1488 | uAGAAGcAGUCCGAUUUGUTsT | 40% | 2% | 28% | 3% |
| ND8485 | 1489 | cAAAucGGAcuGcuucuAcTsT | 1490 | GuAGAAGcAGUCCGAUUUGTsT | 41% | 4% | 38% | 2% |
| ND8486 | 1491 | GcAcccucAAucccuAcAGTsT | 1492 | CUGuAGGGAUUGAGGGUGCTsT | 91% | 7% | 94% | 4% |
| ND8487 | 1493 | ccucAAcAucAAccucAAcTsT | 1494 | GUUGAGGUUGAUGUUGAGGTsT | 46% | 2% | 37% | 3% |
| ND8488 | 1495 | cucAAcAucAAccucAAcuTsT | 1496 | AGUUGAGGUUGAUGUUGAGTsT | 48% | 2% | 39% | 3% |
| ND8489 | 1497 | ucAAcAucAAccucAAcucTsT | 1498 | GAGUUGAGGUUGAUGUUGATsT | 17% | 1% | 17% | 1% |
| ND8490 | 1499 | uAccGcuuccAcuAcAucATsT | 1500 | UGAUGuAGUGGAAGCGGuATsT | 90% | 5% | 74% | 8% |

TABLE 1D-continued

| Duplex ID | Seq ID | Sense | Seq ID | Antisense | 1st screen single dose 50 nM in H441; MV | SD | 2nd screen @ 50 nM in H441 | SD |
|---|---|---|---|---|---|---|---|---|
| ND8491 | 1501 | AccGcuuccAcuAcAucAATsT | 1502 | UUGAUGuAGUGGAAGCGGUTsT | 103% | 4% | 91% | 15% |
| ND8492 | 1503 | GcuuccAcuAcAucAAcAuTsT | 1504 | AUGUUGAUGuAGUGGAAGCTsT | 85% | 3% | 71% | 10% |
| ND8493 | 1505 | cuuccAcuAcAucAAcAucTsT | 1506 | GAUGUUGAUGuAGUGGAAGTsT | 60% | 5% | 45% | 3% |
| ND8494 | 1507 | uccAcuAcAucAAcAuccuTsT | 1508 | AGGAUGUUGAUGuAGUGGATsT | 33% | 3% | 41% | 3% |
| ND8495 | 1509 | ccAcuAcAucAAcAuccuGTsT | 1510 | cAGGAUGUUGAUGuAGUGGTsT | 60% | 5% | 55% | 2% |
| ND8496 | 1511 | cuGGGcAAcuucAucuucGTsT | 1512 | CGAAGAUGAAGUUGCCcAGTsT | 18% | 0% | 20% | 0% |
| ND8497 | 1513 | GGcAAcuucAucuucGccuTsT | 1514 | AGGCGAAGAUGAAGUUGCCTsT | 76% | 1% | 77% | 2% |
| ND8498 | 1515 | uucAucuucGccuGccGcuTsT | 1516 | AGCGGcAGGCGAAGAUGAATsT | 65% | 4% | 74% | 12% |
| ND8499 | 1517 | ucGccuGccGcuucAAccATsT | 1518 | UGGUUGAAGCGGcAGGCGATsT | 86% | 5% | 77% | 3% |
| ND-8653 | 1519 | AAUCGGACUGCUUCUACCATsT | 1520 | UGGUAGAAGCAGUCCGAUUTsT | 16% | 2% | 20% | 3% |
| ND-8654 | 1521 | AUCGGACUGCUUCUACCAGTsT | 1522 | CUGGUAGAAGCAGUCCGAUTsT | 54% | 8% | 67% | 11% |
| ND-8655 | 1523 | AAAUCGGACUGCUUCUACCTsT | 1524 | GGUAGAAGCAGUCCGAUUUTsT | 25% | 4% | 28% | 2% |
| ND-8656 | 1525 | UCGGACUGCUUCUACCAGATsT | 1526 | UCUGGUAGAAGCAGUCCGATsT | 12% | 2% | 17% | 1% |
| ND-8657 | 1527 | ACCAGAACAAAUCGGACUGTsT | 1528 | CAGUCCGAUUUGUUCUGGUTsT | 33% | 3% | 35% | 1% |
| ND-8658 | 1529 | CCAGAACAAAUCGGACUGCTsT | 1530 | GCAGUCCGAUUUGUUCUGGTsT | 27% | 3% | 30% | 2% |
| ND-8659 | 1531 | CAGAACAAAUCGGACUGCUTsT | 1532 | AGCAGUCCGAUUUGUUCUGTsT | 15% | 1% | 22% | 3% |
| ND-8660 | 1533 | CUUCGCCUGCCGCUUCAACTsT | 1534 | GUUGAAGCGGCAGGCGAAGTsT | 69% | 17% | 75% | 10% |
| ND-8661 | 1535 | UGGUACCGCUUCCACUACATsT | 1536 | UGUAGUGGAAGCGGUACCATsT | 16% | 2% | 20% | 3% |
| ND-8662 | 1537 | AUCUUCGCCUGCCGCUUCATsT | 1538 | UGAAGCGGCAGGCGAAGAUTsT | 19% | 2% | 25% | 4% |
| ND-8663 | 1539 | UUCGCCUGCCGCUUCAACCTsT | 1540 | GGUUGAAGCGGCAGGCGAATsT | 90% | 4% | 97% | 10% |
| ND-8664 | 1541 | CACCCUCAAUCCCUACAGGTsT | 1542 | CCUGUAGGGAUUGAGGGUGTsT | 19% | 2% | 25% | 3% |
| ND-8665 | 1543 | AGAACAAAUCGGACUGCUUTsT | 1544 | AAGCAGUCCGAUUUGUUCUTsT | 13% | 1% | 22% | 2% |
| ND-8666 | 1545 | GAACAAAUCGGACUGCUUCTsT | 1546 | GAAGCAGUCCGAUUUGUUCTsT | 11% | 2% | 18% | 2% |
| ND-8667 | 1547 | CGGACUGCUUCUACCAGACTsT | 1548 | GUCUGGUAGAAGCAGUCCGTsT | 13% | 1% | 16% | 2% |
| ND-8668 | 1549 | AGCCUCAACAUCAACCUCATsT | 1550 | UGAGGUUGAUGUUGAGGCUTsT | 17% | 4% | 21% | 3% |
| ND-8669 | 1551 | GCCUCAACAUCAACCUCAATsT | 1552 | UUGAGGUUGAUGUUGAGGCTsT | 13% | 1% | 21% | 3% |
| ND-8670 | 1553 | GUCAGCCUCAACAUCAACCTsT | 1554 | GGUUGAUGUUGAGGCUGACTsT | 43% | 11% | 27% | 3% |
| ND-8671 | 1555 | UCAGCCUCAACAUCAACCUTsT | 1556 | AGGUUGAUGUUGAGGCUGATsT | 90% | 17% | 53% | 13% |
| ND-8672 | 1557 | CAGCCUCAACAUCAACCUCTsT | 1558 | GAGGUUGAUGUUGAGGCUGTsT | 17% | 3% | 11% | 3% |
| ND-8673 | 1559 | GGAGCUGGACCGCAUCACATsT | 1560 | UGUGAUGCGGUCCAGCUCCTsT | 25% | 3% | 18% | 3% |
| ND-8674 | 1561 | GUACCGCUUCCACUACAUCTsT | 1562 | GAUGUAGUGGAAGCGGUACTsT | 21% | 4% | 16% | 4% |
| ND-8675 | 1563 | CCGCUUCCACUACAUCAACTsT | 1564 | GUUGAUGUAGUGGAAGCGGTsT | 25% | 4% | 19% | 3% |
| ND-8676 | 1565 | CGCUUCCACUACAUCAACATsT | 1566 | UGUUGAUGUAGUGGAAGCGTsT | 16% | 3% | 14% | 1% |
| ND-8677 | 1567 | UUCCACUACAUCAACAUCCTsT | 1568 | GGAUGUUGAUGUAGUGGAATsT | 110% | 19% | 97% | 9% |
| ND-8678 | 1569 | UGGGCAACUUCAUCUUCGCTsT | 1570 | GCGAAGAUGAAGUUGCCCATsT | 50% | 8% | 40% | 5% |
| ND-8679 | 1571 | GCAACUUCAUCUUCGCCUGTsT | 1572 | CAGGCGAAGAUGAAGUUGCTsT | 19% | 3% | 17% | 2% |
| ND-8680 | 1573 | CAACUUCAUCUUCGCCUGCTsT | 1574 | GCAGGCGAAGAUGAAGUUGTsT | 25% | 2% | 23% | 2% |

TABLE 1D-continued

| Duplex ID | Seq ID | Sense | Seq ID | Antisense | 1st screen single dose 50 nM in H441; MV | SD | 2nd screen @ 50 nM in H441 | SD |
|---|---|---|---|---|---|---|---|---|
| ND-8681 | 1575 | AACUUCAUCUUCGCCUGCCUTsT | 1576 | GGCAGGCGAAGAUGAAGUUTsT | 104% | 7% | 85% | 10% |
| ND-8682 | 1577 | ACUUCAUCUUCGCCUGCCGTsT | 1578 | CGGCAGGCGAAGAUGAAGUTsT | 91% | 8% | 63% | 9% |
| ND-8683 | 1579 | CUUCAUCUUCGCCUGCCGCTsT | 1580 | GCGGCAGGCGAAGAUGAAGTsT | 88% | 6% | 58% | 6% |
| ND-8684 | 1581 | UCAUCUUCGCCUGCCGCUUTsT | 1582 | AAGCGGCAGGCGAAGAUGATsT | 76% | 3% | 64% | 4% |
| ND-8685 | 1583 | CAUCUUCGCCUGCCGCUUCTsT | 1584 | GAAGCGGCAGGCGAAGAUGTsT | 15% | 1% | 18% | 3% |
| ND-8686 | 1585 | UCUUCGCCUGCCGCUUCAATsT | 1586 | UUGAAGCGGCAGGCGAAGATsT | 109% | 22% | 31% | 3% |
| ND-8687 | 1587 | CGCCUGCCGCUUCAACCAGTsT | 1588 | CUGGUUGAAGCGGCAGGCGTsT | 90% | 21% | 49% | 2% |
| ND-8688 | 1589 | GCCUGCCGCUUCAACCAGGTsT | 1590 | CCUGGUUGAAGCGGCAGGCTsT | 43% | 9% | 24% | 7% |
| ND-8689 | 1591 | AUUACUCUCACUUCCACCATsT | 1592 | UGGUGGAAGUGAGAGUAAUTsT | 27% | 4% | 19% | 2% |
| ND-8690 | 1593 | UUACUCUCACUUCCACCACTsT | 1594 | GUGGUGGAAGUGAGAGUAATsT | 109% | 7% | 85% | 8% |
| ND-8691 | 1595 | ACUCUCACUUCCACCACCCTsT | 1596 | GGGUGGUGGAAGUGAGAGUTsT | 93% | 11% | 87% | 12% |
| ND-8692 | 1597 | UCUGCACCCUCAAUCCCUATsT | 1598 | UAGGGAUUGAGGGUGCAGATsT | 31% | 12% | 17% | 2% |
| ND-8693 | 1599 | CUGCACCCUCAAUCCCUACTsT | 1600 | GUAGGGAUUGAGGGUGCAGTsT | 41% | 25% | 31% | 4% |
| ND-8694 | 1601 | UGCACCCUCAAUCCCUACATsT | 1602 | UGUAGGGAUUGAGGGUGCATsT | 75% | 25% | 43% | 3% |
| ND-8695 | 1603 | ACCCUCAAUCCCUACAGGUTsT | 1604 | ACCUGUAGGGAUUGAGGGUTsT | 65% | 26% | 25% | 5% |
| ND-8696 | 1605 | CCCUCAAUCCCUACAGGUATsT | 1606 | UACCUGUAGGGAUUGAGGGTsT | 18% | 2% | 13% | 1% |
| ND-8697 | 1607 | CCUCAAUCCCUACAGGUACTsT | 1608 | GUACCUGUAGGGAUUGAGGTsT | 16% | 4% | 13% | 2% |
| ND-8698 | 1609 | AACCAGAACAAAUCGGACUTsT | 1610 | AGUCCGAUUUGUUCUGGUUTsT | 40% | 2% | 30% | 2% |
| ND-8699 | 1611 | AACAAAUCGGACUGCUUCUTsT | 1612 | AGAAGCAGUCCGAUUUGUUTsT | 56% | 4% | 45% | 3% |
| ND-8700 | 1613 | ACAAAUCGGACUGCUUCUATsT | 1614 | UAGAAGCAGUCCGAUUUGUTsT | 18% | 3% | 12% | 1% |
| ND-8701 | 1615 | CAAAUCGGACUGCUUCUACTsT | 1616 | GUAGAAGCAGUCCGAUUUGTsT | 15% | 2% | 15% | 4% |
| ND-8702 | 1617 | GCACCCUCAAUCCCUACAGTsT | 1618 | CUGUAGGGAUUGAGGGUGCTsT | 53% | 4% | 46% | 20% |
| ND-8703 | 1619 | CCUCAACAUCAACCUCAACTsT | 1620 | GUUGAGGUUGAUGUUGAGGTsT | 25% | 6% | 26% | 9% |
| ND-8704 | 1621 | CUCAACAUCAACCUCAACUTsT | 1622 | AGUUGAGGUUGAUGUUGAGTsT | 30% | 8% | 37% | 26% |
| ND-8705 | 1623 | UCAACAUCAACCUCAACUCTsT | 1624 | GAGUUGAGGUUGAUGUUGATsT | 55% | 1% | 50% | 10% |
| ND-8706 | 1625 | UACCGCUUCCACUACAUCATsT | 1626 | UGAUGUAGUGGAAGCGGUATsT | 36% | 7% | 31% | 7% |
| ND-8707 | 1627 | ACCGCUUCCACUACAUCAATsT | 1628 | UUGAUGUAGUGGAAGCGGUTsT | 23% | 5% | 27% | 10% |
| ND-8708 | 1629 | GCUUCCACUACAUCAACAUTsT | 1630 | AUGUUGAUGUAGUGGAAGCTsT | 16% | 4% | 24% | 12% |
| ND-8709 | 1631 | CUUCCACUACAUCAACAUCTsT | 1632 | GAUGUUGAUGUAGUGGAAGTsT | 62% | 3% | 74% | 27% |
| ND-8710 | 1633 | UCCACUACAUCAACAUCCUTsT | 1634 | AGGAUGUUGAUGUAGUGGATsT | 45% | 8% | 41% | 1% |
| ND-8711 | 1635 | CCACUACAUCAACAUCCUGTsT | 1636 | CAGGAUGUUGAUGUAGUGGTsT | 23% | 4% | 27% | 10% |
| ND-8712 | 1637 | CUGGGCAACUUCAUCUUCGTsT | 1638 | CGAAGAUGAAGUUGCCCAGTsT | 34% | 4% | 26% | 5% |
| ND-8713 | 1639 | GGCAACUUCAUCUUCGCCUTsT | 1640 | AGGCGAAGAUGAAGUUGCCTsT | 30% | 3% | 23% | 2% |
| ND-8714 | 1641 | UUCAUCUUCGCCUGCCGCUTsT | 1642 | AGCGGCAGGCGAAGAUGAATsT | 90% | 14% | 85% | 14% |
| ND-8715 | 1643 | UCGCCUGCCGCUUCAACCATsT | 1644 | UGGUUGAAGCGGCAGGCGATsT | 23% | 2% | 20% | 4 |

TABLE 2A

Concentration at 50% inhibition (IC50) for exemplary iRNA agents of Table 1A

| Duplex ID | IC50 [nM] 1st DRC in H441 | IC50 [nM] 2nd DRC in H441 |
|---|---|---|
| ND8294 | 0.1949 | 0.0468 |
| ND8295 | 0.1011 | 0.0458 |
| ND8299 | 0.5986 | 0.5638 |
| ND8302 | 0.0144 | 0.0134 |
| ND8313 | 0.0315 | 0.0124 |
| ND8320 | 0.0796 | 0.0078 |
| ND8331 | 0.0213 | 0.0158 |
| ND8332 | 0.0205 | 0.0089 |
| ND8343 | 0.0523 | 0.0293 |
| ND8348 | 0.0156 | 0.0182 |
| ND8356 | 0.0241 | 0.0099 |
| ND8357 | 0.0054 | 0.0032 |
| ND8363 | 0.1186 | 0.0337 |
| ND8368 | 0.0487 | 0.1209 |
| ND8371 | 0.0811 | 0.0911 |
| ND8372 | 0.0584 | 0.0425 |
| ND8373 | 0.0066 | 0.0165 |
| ND8375 | 0.1176 | 0.1187 |
| ND8380 | 0.6817 | 0.5747 |
| ND8381 | 0.0037 | 0.0041 |
| ND8383 | 0.0275 | 0.1257 |
| ND8384 | 0.0357 | 0.0082 |
| ND8391 | 0.0260 | 0.0349 |
| ND8392 | 0.3831 | 0.4775 |
| ND8396 | 0.0023 | 0.0052 |
| ND8403 | 0.0808 | 0.0759 |

TABLE 2B

Concentration at 50% inhibition (IC50) and for exemplary iRNA agents of Table 1D

| Duplex ID | IC50 [nM] 1st DRC in H441 | IC50 [nM] 2nd DRC in H441 |
|---|---|---|
| ND8441 | 0.6738 | 0.8080 |
| ND8443 | 0.0346 | 0.0263 |
| ND8449 | 0.0120 | 0.0067 |
| ND8450 | 0.0257 | 0.0106 |
| ND8451 | 0.1320 | 0.0931 |
| ND8453 | 0.0079 | 0.0033 |
| ND8489 | 0.1640 | 0.1593 |
| ND8496 | 0.0387 | 0.0185 |

TABLE 2C

% Activity of the exemplary RNAi towards inhibition of alpha-ENaC gene expression in the assays described in Example 3

| Duplex identifier | % alpha-ENaC expression in primary HBEC (% of control) 50 nM siRNA | Cynomolgous alpha-ENaC expression (% of control) 45 nM siRNA |
|---|---|---|
| Untransfected | 77.2 | n/a |
| Non-targetting Control | 100 | 93.3 |
| Negative Control (Non-cyno alpha-ENaC) ND8449 | n/a | 100 |
| ND-8302 | 30.2 | 57 |
| ND-8332 | 24.7 | 54.3 |
| ND-8348 | 40.1 | 56.2 |
| ND-8356 | 36.6 | 55.8 |
| ND-8357 | 29.6 | 50.4 |
| ND-8373 | 30.4 | 53.8 |
| ND-8381 | 32.5 | 40.4 |
| ND-8396 | 34.1 | 46.3 |
| ND-8450 | 45.9 | 78.9 |
| ND-8453 | 30.1 | 55.3 |

TABLE 3A

DNA sequence of cynomologous mondkey alpha-EnaC (SEQ ID NO:1682)

GAATTCGCCCTTGGCCGCTGCACCTGTAGGGGAACAAGCTGGAGGAGCAG

GACCCTAGACCTCTGCAGCCCACCGCAGGGCTCATGGAGGGGAACAAGCT

GGAGGAGCAGGACGCTAGCCCTCCACAGCCCACCCCAGGGCTCATGAAGG

GGGACAAGCGTGAGGAGCAGGGGCTGGGCCCAGAACCTGCGGCACCCCAG

CAGCCCACGGCGGAGGAGGAGGCCCTGATCGAGTTCCACCGCTCCTACCG

AGAGCTCTTCGAGTTCTTCTGCAACAATACCACCATCCACGGCGCCATCC

GCCTGGTGTGCTCCCAGCACAACCGCATGAAGACGGCCTTCTGGGCAGTG

CTCTGGCTCTGCACCTTTGGCATGATGTACTGGCAATTCGGCCTGCTTTT

CGGAGAGTACTTCAGCTACCCCGTCAGCCTCAACATCAACCTCAACTCGG

ACAAGCTTGTCTTCCCCGCAGTGACCATCTGCACCCTCAATCCCTACAGG

TATCCGGAAATTAAAGAGGAGCTGGAGGAGCTGGACCGCATCACACAGCA

GACGCTCTTTGACCTGTACAAATACGACTCCTCCCCCACCCTCGTGGCCG

GCTCCCGCGGCCGTCGTGACCTGCGGGGCACTCTGCCGCACCTCTTGCAG

CGCCTGAGGGTCCCGTCCCCGCTTCACGGGGCCCGTCAAGCCCGTAGCGT

GGCCTCCAGCGTGCGGGACAACAACCCCCAAGTGGACTGGAAGGACTGGA

AGATCGGTTTCGAGCTGTGCAACCAGAACAAATCAGACTGCTTCTACCAG

ACATACTCATCAGGGGTGGATGCAGTGAGGGAGTGGTACCGCTTCCACTA

CATCAACATCCTGTCGAGGCTGCCAGAGACTCTGCCATCCCTGGAGGAGG

ACACACTGGGCAACTTCATCTTCGCCTGCCGCTTCAACCAGGTCTCCTGC

AACCAGGCGAATTACTCTCACTTCCACCACCCAATGTATGGAAACTGCTA

TACTTTCAATGACAAGAACAACTCTAACCTCTGGATGTCTTCCATGCCTG

GAGTCAACAACGGTCTGTCCCTGATGCTGCGCACAGAGCAGAATGACTTC

ATTCCCCTGCTGTCCACAGTGACTGGGGCCCGGGTAATGGTGCACGGGCA

GGATGAACCTGCCTTTATGGATGATGGTGGCTTTAACTTGCGGCCTGGCG

TGGAGACCTCCATCAGCATGAGGAAGGAAGCCCTGGACAGACTTGGGGGC

GACTATGGCGACTGCACCAAGAATGGCAGTGATGTCCCTGTCAAGAACCT

TTACCCTTCAAAGTACACGCGCAGGTGTGTATTCACTCCTGCTTCCAGG

AGAACATGATCAAGGAGTGTGGCTGTGCCTACATCTTCTATCCGCGGCCG

CAGAACATGGAGTACTGTGACTACAGGAAGCACAGTTCCTGGGGCTACTG

TABLE 3A-continued

DNA sequence of cynomologous mondkey alpha-EnaC

CTACTATAAGCTCCAGGCTGACTTCTCCTCAGACCACCTGGGCTGTTTCA

CCAAGTGCCGGAAGCCATGCAGTGTGACCAGCTACCAGCTCTCGGCTGGT

TACTCACGATGGCCCTCGGTGACATCCCAGGAATGGGTCTTCGAGATGCT

ATCGCGACAGAACAACTACACCATCAACAACAAGAGAAATGGAGTGGCCA

AAGTCAACATCTTCTTCAAGGAGCTGAACTACAAAACCAATTCTGAGTCT

CCCTCTGTCACGATGGTCACCCTCCTGTCCAACCTGGGCAGCCAGTGGAG

CCTGTGGTTCGGCTCCTCAGTGCTGTCTGTGGTGGAGATGGCTGAGCTCA

TCTTTGACCTGCTGGTCATCACATTCCTCCTGCTGCTCCGAAGGTTCCGA

AGCCGATACTGGTCTCCAGGCCGAGGGACAGGGGTGCTCAGGAGGTGGC

CTCCACCCAGGCATCCTCCCCGCCTTCCCACTTCTGCCCCCACCCCACAT

CTCTGTACTTGTCCCAACTAGGCCCTGCTCCCTCCCCAGCCTTGACAGCC

CCTCCCCCTGCCTATGCCACCCTGGGCCCCTGCCCATCTCCAGGGGGCTC

CGCAGGGGCCAGCTCCACTGCCTATCCTCTGGGGGGGCCCTGAGAGAGGA

GAGGTTCCTTGCACCAAGGCAGATGCTCCCCTGGTGGGAGGGTGCTGCCC

TTGGCAAGATTGAAGGATGTGCAGGGCTTCCTCTCAGAGCCGCCCAAACT

GCCCTTGATGTGTGGAGGGGAAGCGAGATGGGTAAGGGGCTCAGGAAGTT

GTTCCAAGAACAGTGGCCAATGAAGCTGCCCAGAAGTGCCTTGGCTCTGG

CTCTGTACCCCTTGGTACTGCCTCTGAACACTCTGGTTTCCCCACCCAAC

TGCAGCTAAGTCTCCTTTTCCCTTGGATCAGCCAAGCCAAACTTGGAGCT

TTGACAAGGAACTTTCCTAAGAAATGGCTGATGACCAGGACAAAACACAA

CCAAGGGTACACACAGGCATGCACGCGTTTCCTGCCTGGCGACAGGTGAA

GCCAGCCCCTGACTGACCTGGCCACACTGCTCTCCAGTAACACAGATGTC

TGCCCCTCATCTTGAACTTGGGTGGGAAACCCCACCCAAAAGCCCCCTTT

ATTACTTAGGCAATTCCCCTTCCCTGACTCCCGAGAGCCAGGGCCAGAGC

AGACCCGTATAAGTAAAGGCAGCTCCAGGGCTCCTCTAGGCTCATACCCG

TGCCCTCACAGAGCCATGCTCCAGCGCTTCTGTCCTGTGTCTTTCGTCCC

TCTACATGTCTGCTCAAGACATTTTCTCAGCCTGAAAGCTTCCCCAGCCA

TCTGCCGGAGAACTCCTATGCATCCCTCAGAACCCTGCTCAGACACCATT

ACTTTTGTGAAGGCTTCTGCCACATCTTGTCGTCCCAAAAATTGATCACT

CCCCTTTCTGGTGGGCTCCCGTAGCACACTATAACATCTGCTGGAGTGTT

GCTGTTGCACCATACTTTCTTGTACGTTTGTGTCTGCCTCCCCAACTGGA

CTGTGAGGGCCTTGTGGCCAGGGACTGAGTCTTGCCCGTTTATGTATGCT

CCGTGTCTAGCCCATCATCCTGCTTGAAGCAAGTAGGCAGATGCTCAAAA

GGGCGAATTCTGCAGATATC

TABLE 3B

Protein sequence of cynomologous mondkey alpha-EnaC (SEQ ID NO:1681) which is a Translation of SEQ ID NO:1682.

MEGNKLEEQDASPPQPTPGLMKGDKREEQGLGPEPAAPQQPTAEEEALIE

FHRSYRELFEFFCNNTTIHGAIRLVCSQHNRMKTAFWAVLWLCTFGMMYW

QFGLLFGEYFSYPVSLNINLNSDKLVFPAVTICTLNPYRYPEIKEELEEL

DRITQQTLFDLYKYDSSPTLVAGSRGRRDLRGTLPHLLQRLRVPSPLHGA

RQARSVASSVRDNNPQVDWKDWKIGFELCNQNKSDCFYQTYSSGVDAVRE

WYRFHYINILSRLPETLPSLEEDTLGNFIFACRFNQVSCNQANYSHFHHP

MYGNCYTFNDKNNSNLWMSSMPGVNNGLSLMLRTEQNDFIPLLSTVTGAR

VMVHGQDEPAFMDDGGFNLRPGVETSISMRKEALDRLGGDYGDCTKNGSD

VPVKNLYPSKYTQQVCIHSCFQENMIKECGCAYIFYPRPQNMEYCDYRKH

SSWGYCYYKLQADFSSDHLGCFTKCRKPCSVTSYQLSAGYSRWPSVTWQE

WVFEMLSRQNNYTINNKRNGVAKVNIFFKELNYKTNSESPSVTMVTLLSN

LGSQWSLWFGSSVLSVVEMAELIFDLLVITFLLLLRRFRSRYWSPGRGDR

GAQEVASTQASSPPSHFCPHPTSLYLSQLGPAPSPALTAPPPAYATLGPC

PSPGGSAGASSTAYPLGGP

It is to be understood that while the invention has been described in conjuction with the detailed specification detailed above, the foregoing description is intended to illustrate and not limit the scope of the invention, which is defined by the appended claims. While the invention has been described in connection with specific embodiments thereof, it will be further understood that it is capable of modification. This application is intended to cover variations, uses or adaptations of the invention following the general principles of the invention, including such departures from the present disclosure that comes within known or customary practice within the art to which the present invention pertains and that can be applied to the essential features disclosed herein.

SEQUENCE LISTING (1710 sequences)

SEQ ID NO: 1 - DNA, 21 bp, Artificial sequence
  Synthetic sequence: human-rhesus ENaC alpha cross-reactive siRNA
  modified_base (3)..(5): cm
  modified_base (7)..(7): um
  modified_base (10)..(10): cm
  modified_base (12)..(12): um
  modified_base (15)..(16): cm
  modified_base (17)..(17): um
  modified_base (18)..(19): cm
  misc_feature (20)..(20): t is 2prime - deoxy - thymidine - 5prime - phosphorothioate
agcccguagcguggccucctt

SEQ ID NO: 2 - DNA, 21 bp, Artificial sequence
  Synthetic sequence: human-rhesus ENaC alpha cross-reactive siRNA
  modified_base (7)..(7): cm
  modified_base (12)..(12): um
  misc_feature (20)..(20): t is 2prime - deoxy - thymidine - 5prime - phosphorothioate
ggaggccacgcuacgggcutt

SEQ ID NO: 3 - DNA, 21 bp, Artificial sequence
  Synthetic sequence: human-rhesus ENaC alpha cross-reactive siRNA
  modified_base (1)..(2): cm
  modified_base (6)..(6): um
  modified_base (9)..(9): um
  modified_base (12)..(12): um
  modified_base (14)..(14): cm
  modified_base (16)..(16): cm
  misc_feature (20)..(20): t is 2prime - deoxy - thymidine - 5prime - phosphorothioate
ccggguaauggugcacgggtt

SEQ ID NO: 4 - DNA, 21 bp, Artificial sequence
  Synthetic sequence: human-rhesus ENaC alpha cross-reactive siRNA
  modified_base (7)..(7): cm
  modified_base (10)..(10): cm
  modified_base (13)..(13): um
  misc_feature (20)..(20): t is 2prime - deoxy - thymidine - 5prime - phosphorothioate
cccgugcaccauuacccggtt

SEQ ID NO: 5 - DNA, 21 bp, Artificial sequence
  Synthetic sequence: human-rhesus ENaC alpha cross-reactive siRNA
  modified_base (2)..(2): um
  modified_base (4)..(4): cm
  modified_base (5)..(5): um
  modified_base (7)..(7): um
  modified_base (8)..(8): cm
  modified_base (10)..(10): cm
  modified_base (13)..(13): cm
  modified_base (18)..(18): cm
  misc_feature (20)..(20): t is 2prime - deoxy - thymidine - 5prime - phosphorothioate
augcuaucgcgacagaacatt

SEQ ID NO: 6 - DNA, 21 bp, Artificial sequence
  Synthetic sequence: human-rhesus ENaC alpha cross-reactive siRNA
  modified_base (14)..(14): um
  modified_base (17)..(17): cm
  misc_feature (20)..(20): t is 2prime - deoxy - thymidine - 5prime - phosphorothioate
uguucugucgcgauagcautt

SEQ ID NO: 7 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (6)..(6): um
  modified_base (7)..(7): cm
  modified_base (9)..(9): cm
  modified_base (12)..(12): cm
  modified_base (17)..(17): cm
  misc_feature (20)..(20): t is 2prime - deoxy - thymidine - 5prime - phosphorothioate
ugcuaucgcgacagaacaatt

SEQ ID NO: 8 - DNA, 21 bp, Artificial sequence
  Synthetic sequence: human-rhesus ENaC alpha cross-reactive siRNA
  modified_base (15)..(15): um
  modified_base (18)..(18): cm
  misc_feature (20)..(20): t is 2prime - deoxy - thymidine - 5prime - phosphorothioate
uuguucugucgcgauagcatt

SEQ ID NO: 9 - DNA, 21 bp, Artificial sequence
  Synthetic sequence: human-rhesus ENaC alpha cross-reactive siRNA
  modified_base (2)..(4): cm
  modified_base (6)..(8): um
  modified_base (10)..(10): um
  modified_base (12)..(12): um
  modified_base (14)..(14): um
  modified_base (16)..(16): cm
  modified_base (17)..(17): um
  modified_base (18)..(19): cm
  misc_feature (20)..(20): t is 2prime - deoxy - thymidine - 5prime - phosphorothioate
gcccguuuauguaugcucctt

SEQ ID NO: 10 - DNA, 21 bp, Artificial sequence
  Synthetic sequence: human-rhesus ENaC alpha cross-reactive siRNA
  modified_base (5)..(5): cm
  modified_base (7)..(7): um
  modified_base (9)..(9): cm
  modified_base (11)..(11): um
  misc_feature (20)..(20): t is 2prime - deoxy - thymidine - 5prime - phosphorothioate
ggagcauacauaaacgggctt

SEQ ID NO: 11 - DNA, 21 bp, Artificial sequence
  Synthetic sequence: human-rhesus ENaC alpha cross-reactive siRNA
  modified_base (2)..(4): cm
  modified_base (6)..(6): um
  modified_base (9)..(9): cm
  modified_base (11)..(11): um
  modified_base (14)..(15): cm
  modified_base (16)..(16): um
  modified_base (17)..(18): cm
  misc_feature (20)..(20): t is 2prime - deoxy - thymidine - 5prime - phosphorothioate
gcccguagcguggccuccatt

SEQ ID NO: 12 - DNA, 21 bp, Artificial sequence
  Synthetic sequence: human-rhesus ENaC alpha cross-reactive siRNA
  modified_base (8)..(8): cm
  modified_base (13)..(13): um
  misc_feature (20)..(20): t is 2prime - deoxy - thymidine - 5prime - phosphorothioate
uggaggccacgcuacgggctt

SEQ ID NO: 13 - DNA, 21 bp, Artificial sequence
  Synthetic sequence: human-rhesus ENaC alpha cross-reactive siRNA
  modified_base (1)..(2): cm
  modified_base (8)..(9): um
  modified_base (19)..(19): cm
  misc_feature (20)..(20): t is 2prime - deoxy - thymidine - 5prime - phosphorothioate
ccggaaauuaaagaggagctt

SEQ ID NO: 14 - DNA, 21 bp, Artificial sequence
  Synthetic sequence: human-rhesus ENaC alpha cross-reactive siRNA
  modified_base (10)..(10): um
  misc_feature (20)..(20): t is 2prime - deoxy - thymidine - 5prime - phosphorothioate
gcuccucuuuaauuuccggtt

SEQ ID NO: 15 - DNA, 21 bp, Artificial sequence
  Synthetic sequence: human-rhesus ENaC alpha cross-reactive siRNA
  modified_base (1)..(2): cm
  modified_base (8)..(9): um
  modified_base (10)..(11): cm
  modified_base (16)..(17): cm
  misc_feature (20)..(20): t is 2prime - deoxy - thymidine - 5prime - phosphorothioate
ccgaagguuccgaagccgatt

SEQ ID NO: 16 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucggcuucggaaccuucggtt

SEQ ID NO: 17 - DNA, 21 bp, Artificial sequence
  Synthetic sequence: human-rhesus ENaC alpha cross-reactive siRNA
  modified_base (2)..(2): cm
  modified_base (5)..(6): um
  modified_base (7)..(7): cm
  modified_base (10)..(11): cm
  modified_base (12)..(12): um
  modified_base (14)..(14): cm
  modified_base (15)..(18): um
  modified_base (19)..(19): cm
  misc_feature (20)..(20): t is 2prime - deoxy - thymidine - 5prime - phosphorothioate
gcaauucggccugcuuuuctt

SEQ ID NO: 18 - DNA, 21 bp, Artificial sequence
  Synthetic sequence: human-rhesus ENaC alpha cross-reactive siRNA
  modified_base (7)..(7): cm
  misc_feature (20)..(20): t is 2prime - deoxy - thymidine - 5prime - phosphorothioate
gaaaagcaggccgaauugctt

SEQ ID NO: 19 - DNA, 21 bp, Artificial sequence
  Synthetic sequence: human-rhesus ENaC alpha cross-reactive siRNA
  modified_base (3)..(3): cm
  modified_base (7)..(8): um
  modified_base (10)..(10): cm
  modified_base (11)..(11): um
  modified_base (12)..(12): cm
  modified_base (13)..(13): um
  modified_base (14)..(14): cm
  modified_base (16)..(16): cm
  modified_base (17)..(18): um
  modified_base (19)..(19): cm
  misc_feature (20)..(20): t is 2prime - deoxy - thymidine - 5prime - phosphorothioate
ggcgaauuacucucacuuctt

SEQ ID NO: 20 - DNA, 21 bp, Artificial sequence
  Synthetic sequence: human-rhesus ENaC alpha cross-reactive siRNA
  modified_base (11)..(11): um
  misc_feature (20)..(20): t is 2prime - deoxy - thymidine - 5prime - phosphorothioate
gaagugagaguaauucgcctt

SEQ ID NO: 21 - DNA, 21 bp, Artificial sequence
  Synthetic sequence: human-rhesus ENaC alpha cross-reactive siRNA
  modified_base (2)..(2): cm
  modified_base (6)..(7): um
  modified_base (9)..(9): cm
  modified_base (10)..(10): um
  modified_base (11)..(11): cm
  modified_base (12)..(12): um
  modified_base (13)..(13): cm
  modified_base (15)..(15): cm
  modified_base (16)..(17): um
  modified_base (18)..(19): cm
  misc_feature (20)..(20): t is 2prime - deoxy - thymidine - 5prime - phosphorothioate
gcgaauuacucucacuucctt

SEQ ID NO: 22 - DNA, 21 bp, Artificial sequence
  Synthetic sequence: human-rhesus ENaC alpha cross-reactive siRNA
  modified_base (12)..(12): um
  misc_feature (20)..(20): t is 2prime - deoxy - thymidine - 5prime - phosphorothioate
ggaagugagaguaauucgctt

SEQ ID NO: 23 - DNA, 21 bp, Artificial sequence
  Synthetic sequence: human-rhesus ENaC alpha cross-reactive siRNA
  modified_base (3)..(4): cm
  modified_base (8)..(8): cm
  modified_base (12)..(13): um
  modified_base (15)..(15): cm
  modified_base (16)..(16): um
  modified_base (17)..(17): cm
  modified_base (18)..(18): um
  modified_base (19)..(19): cm
  misc_feature (20)..(20): t is 2prime - deoxy - thymidine - 5prime - phosphorothioate
aaccaggcgaauuacucuctt

SEQ ID NO: 24 - DNA, 21 bp, Artificial sequence
  Synthetic sequence: human-rhesus ENaC alpha cross-reactive siRNA
  modified_base (6)..(6): um
  misc_feature (20)..(20): t is 2prime - deoxy - thymidine - 5prime - phosphorothioate
gagaguaauucgccugguutt

SEQ ID NO: 25 - DNA, 21 bp, Artificial sequence
  Synthetic sequence: human-rhesus ENaC alpha cross-reactive siRNA
  modified_base (3)..(3): um
  modified_base (6)..(6): um
  modified_base (9)..(9): um
  modified_base (11)..(11): cm
  modified_base (13)..(13): cm
  modified_base (17)..(17): cm
  misc_feature (20)..(20): t is 2prime - deoxy - thymidine - 5prime - phosphorothioate
gguaauggugcacgggcagtt

SEQ ID NO: 26 - DNA, 21 bp, Artificial sequence
  Synthetic sequence: human-rhesus ENaC alpha cross-reactive siRNA
  modified_base (10)..(10): cm
  modified_base (13)..(13): cm
  modified_base (16)..(16): um
  misc_feature (20)..(20): t is 2prime - deoxy - thymidine - 5prime - phosphorothioate
cugcccgugcaccauuacctt

SEQ ID NO: 27 - DNA, 21 bp, Artificial sequence
  Synthetic sequence: human-rhesus ENaC alpha cross-reactive siRNA
  modified_base (1)..(1): cm
  modified_base (2)..(2): um
  modified_base (3)..(3): cm
  modified_base (5)..(5): cm
  modified_base (8)..(8): um
  modified_base (11)..(13): cm
  modified_base (14)..(14): um
  modified_base (15)..(15): cm
  modified_base (18)..(18): um
  misc_feature (20)..(20): t is 2prime - deoxy - thymidine - 5prime - phosphorothioate
cucacgauggcccucggugtt

SEQ ID NO: 28 - DNA, 21 bp, Artificial sequence
  Synthetic sequence: human-rhesus ENaC alpha cross-reactive siRNA
  modified_base (1)..(1): cm
  modified_base (11)..(11): cm
  misc_feature (20)..(20): t is 2prime - deoxy - thymidine - 5prime - phosphorothioate
caccgagggccaucgugagtt

SEQ ID NO: 29 - DNA, 21 bp, Artificial sequence
  Synthetic sequence: human-rhesus ENaC alpha cross-reactive siRNA
  modified_base (2)..(2): cm
  modified_base (3)..(3): um
  modified_base (4)..(5): cm
  modified_base (11)..(12): um
  modified_base (13)..(14): cm
  modified_base (19)..(19): cm
  misc_feature (20)..(20): t is 2prime - deoxy - thymidine - 5prime - phosphorothioate
gcuccgaagguuccgaagctt

SEQ ID NO: 30 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuucggaaccuucggagctt

SEQ ID NO: 31 - DNA, 21 bp, Artificial sequence
  Synthetic sequence: human-rhesus ENaC alpha cross-reactive siRNA
  modified_base (2)..(3): cm
  modified_base (6)..(6): um
  modified_base (8)..(8): cm
  modified_base (9)..(9): um
  modified_base (12)..(12): um
  modified_base (13)..(13): cm
  modified_base (14)..(14): um
  modified_base (15)..(16): cm
  misc_feature (20)..(20): t is 2prime - deoxy - thymidine - 5prime - phosphorothioate
gccgauacuggucuccaggtt

SEQ ID NO: 32 - DNA, 21 bp, Artificial sequence
  Synthetic sequence: human-rhesus ENaC alpha cross-reactive siRNA
  modified_base (10)..(10): cm
  modified_base (13)..(13): um
  misc_feature (20)..(20): t is 2prime - deoxy - thymidine - 5prime - phosphorothioate
ccuggagaccaguaucggctt

SEQ ID NO: 33 - DNA, 21 bp, Artificial sequence
  Synthetic sequence: human-rhesus ENaC alpha cross-reactive siRNA
  modified_base (1)..(2): cm
  modified_base (5)..(5): um
  modified_base (7)..(7): cm
  modified_base (8)..(8): um
  modified_base (11)..(11): um
  modified_base (12)..(12): cm
  modified_base (13)..(13): um
  modified_base (14)..(15): cm
  modified_base (19)..(19): cm
  misc_feature (20)..(20): t is 2prime - deoxy - thymidine - 5prime - phosphorothioate
ccgauacuggucuccaggctt

SEQ ID NO: 34 - DNA, 21 bp, Artificial sequence
  Synthetic sequence: human-rhesus ENaC alpha cross-reactive siRNA
  modified_base (11)..(11): cm
  modified_base (14)..(14): um
  misc_feature (20)..(20): t is 2prime - deoxy - thymidine - 5prime - phosphorothioate
gccuggagaccaguaucggtt

SEQ ID NO: 35 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (6)..(7): um
  modified_base (9)..(9): cm
  modified_base (11)..(12): cm
  modified_base (14)..(14): um
  modified_base (16)..(16): cm
  modified_base (17)..(19): um
  misc_feature (20)..(20): t is 2prime - deoxy - thymidine - 5prime - phosphorothioate
ugcuguugcaccauacuuutt

SEQ ID NO: 36 - DNA, 21 bp, Artificial sequence
  Synthetic sequence: human-rhesus ENaC alpha cross-reactive siRNA
  modified_base (5)..(5): um
  modified_base (12)..(12): cm
  modified_base (15)..(15): cm
  modified_base (18)..(18): cm
  misc_feature (20)..(20): t is 2prime - deoxy - thymidine - 5prime - phosphorothioate
aaaguauggugcaacagcatt

SEQ ID NO: 37 - DNA, 21 bp, Artificial sequence
  Synthetic sequence: human-rhesus ENaC alpha cross-reactive siRNA
  modified_base (3)..(3): cm
  modified_base (6)..(6): um
  modified_base (7)..(7): cm
  modified_base (8)..(8): um
  modified_base (10)..(10): um
  modified_base (11)..(13): cm
  modified_base (14)..(14): um
  modified_base (17)..(17): um
  modified_base (19)..(19): cm
  misc_feature (20)..(20): t is 2prime - deoxy - thymidine - 5prime - phosphorothioate
aacggucugucccugaugctt

SEQ ID NO: 38 - DNA, 21 bp, Artificial sequence
  Synthetic sequence: human-rhesus ENaC alpha cross-reactive siRNA
  modified_base (2)..(2): cm
  modified_base (5)..(5): cm
  modified_base (11)..(11): cm
  misc_feature (20)..(20): t is 2prime - deoxy - thymidine - 5prime - phosphorothioate
gcaucagggacagaccguutt

SEQ ID NO: 39 - DNA, 21 bp, Artificial sequence
  Synthetic sequence: human-rhesus ENaC alpha cross-reactive siRNA
  modified_base (1)..(2): um
  modified_base (5)..(5): cm
  modified_base (6)..(7): um
  modified_base (9)..(9): cm
  modified_base (12)..(13): cm
  modified_base (14)..(14): um
  modified_base (17)..(17): cm
  modified_base (19)..(19): um
  misc_feature (20)..(20): t is 2prime - deoxy - thymidine - 5prime - phosphorothioate
uuaacuugcggccuggcgutt

SEQ ID NO: 40 - DNA, 21 bp, Artificial sequence
  Synthetic sequence: human-rhesus ENaC alpha cross-reactive siRNA
  modified_base (5)..(5): cm
  modified_base (12)..(12): cm
  modified_base (17)..(17): um
  misc_feature (20)..(20): t is 2prime - deoxy - thymidine - 5prime - phosphorothioate
acgccaggccgcaaguuaatt

SEQ ID NO: 41 - DNA, 21 bp, Artificial sequence
  Synthetic sequence: human-rhesus ENaC alpha cross-reactive siRNA
  modified_base (2)..(2): cm
  modified_base (3)..(3): um
  modified_base (6)..(7): um
  modified_base (9)..(9): cm
  modified_base (10)..(10): um
  modified_base (11)..(11): cm
  modified_base (13)..(13): cm
  modified_base (16)..(16): um
  modified_base (19)..(19): cm
  misc_feature (20)..(20): t is 2prime - deoxy - thymidine - 5prime - phosphorothioate
gcugguuacucacgauggctt

SEQ ID NO: 42 - DNA, 21 bp, Artificial sequence
  Synthetic sequence: human-rhesus ENaC alpha cross-reactive siRNA
  modified_base (3)..(3): cm
  modified_base (12)..(12): um
  modified_base (16)..(16): cm
  misc_feature (20)..(20): t is 2prime - deoxy - thymidine - 5prime - phosphorothioate
gccaucgugaguaaccagctt

SEQ ID NO: 43 - DNA, 21 bp, Artificial sequence
  Synthetic sequence: human-rhesus ENaC alpha cross-reactive siRNA
  modified_base (1)..(2): um
  modified_base (4)..(4): cm
  modified_base (5)..(5): um
  modified_base (6)..(6): cm
  modified_base (8)..(8): cm
  modified_base (11)..(11): um
  modified_base (14)..(16): cm
  modified_base (17)..(17): um
  modified_base (18)..(18): cm
  misc_feature (20)..(20): t is 2prime - deoxy - thymidine - 5prime - phosphorothioate
uuacucacgauggcccucgtt

SEQ ID NO: 44 - DNA, 21 bp, Artificial sequence
  Synthetic sequence: human-rhesus ENaC alpha cross-reactive siRNA
  modified_base (8)..(8): cm
  modified_base (17)..(17): um
  misc_feature (20)..(20): t is 2prime - deoxy - thymidine - 5prime - phosphorothioate
cgagggccaucgugaguaatt

SEQ ID NO: 45 - DNA, 21 bp, Artificial sequence
  Synthetic sequence: human-rhesus ENaC alpha cross-reactive siRNA
  modified_base (5)..(6): cm
  modified_base (9)..(9): um
  modified_base (11)..(11): cm
  modified_base (12)..(12): um
  modified_base (15)..(15): um
  modified_base (16)..(16): cm
  modified_base (17)..(17): um
  modified_base (18)..(19): cm
  misc_feature (20)..(20): t is 2prime - deoxy - thymidine - 5prime - phosphorothioate
gaagccgauacuggucucctt

SEQ ID NO: 46 - DNA, 21 bp, Artificial sequence
  Synthetic sequence: human-rhesus ENaC alpha cross-reactive siRNA
  modified_base (7)..(7): cm
  modified_base (10)..(10): um
  misc_feature (20)..(20): t is 2prime - deoxy - thymidine - 5prime - phosphorothioate
ggagaccaguaucggcuuctt

SEQ ID NO: 47 - DNA, 21 bp, Artificial sequence
  Synthetic sequence: human-rhesus ENaC alpha cross-reactive siRNA
  modified_base (3)..(3): um
  modified_base (5)..(5): cm
  modified_base (6)..(6): um
  modified_base (9)..(9): um
  modified_base (10)..(10): cm
  modified_base (11)..(11): um
  modified_base (12)..(13): cm
  modified_base (17)..(18): cm
  misc_feature (20)..(20): t is 2prime - deoxy - thymidine - 5prime - phosphorothioate
gauacuggucuccaggccgtt

SEQ ID NO: 48 - DNA, 21 bp, Artificial sequence
  Synthetic sequence: human-rhesus ENaC alpha cross-reactive siRNA
  modified_base (13)..(13): cm
  modified_base (16)..(16): um
  misc_feature (20)..(20): t is 2prime - deoxy - thymidine - 5prime - phosphorothioate
cggccuggagaccaguauctt

SEQ ID NO: 49 - DNA, 21 bp, Artificial sequence
  Synthetic sequence: human-rhesus ENaC alpha cross-reactive siRNA
  modified_base (2)..(2): um
  modified_base (4)..(4): cm
  modified_base (5)..(5): um
  modified_base (8)..(8): um
  modified_base (9)..(9): cm
  modified_base (10)..(10): um
  modified_base (11)..(12): cm
  modified_base (16)..(17): cm
  misc_feature (20)..(20): t is 2prime - deoxy - thymidine - 5prime - phosphorothioate
auacuggucuccaggccgatt

SEQ ID NO: 50 - DNA, 21 bp, Artificial sequence
  Synthetic sequence: human-rhesus ENaC alpha cross-reactive siRNA
  modified_base (14)..(14): cm
  modified_base (17)..(17): um
  misc_feature (20)..(20): t is 2prime - deoxy - thymidine - 5prime - phosphorothioate
ucggccuggagaccaguautt

SEQ ID NO: 51 - DNA, 21 bp, Artificial sequence
  Synthetic sequence: human-rhesus ENaC alpha cross-reactive siRNA
  modified_base (1)..(1): cm
  modified_base (4)..(4): cm
  modified_base (7)..(7): um
  modified_base (8)..(8): cm
  modified_base (9)..(9): um
  modified_base (11)..(11): um
  modified_base (12)..(14): cm
  modified_base (15)..(15): um
  modified_base (18)..(18): um
  misc_feature (20)..(20): t is 2prime - deoxy - thymidine - 5prime - phosphorothioate
caacggucugucccugaugtt

SEQ ID NO: 52 - DNA, 21 bp, Artificial sequence
  Synthetic sequence: human-rhesus ENaC alpha cross-reactive siRNA
  modified_base (1)..(1): cm
  modified_base (4)..(4): cm
  modified_base (10)..(10): cm
  misc_feature (20)..(20): t is 2prime - deoxy - thymidine - 5prime - phosphorothioate
caucagggacagaccguugtt

SEQ ID NO: 53 - DNA, 21 bp, Artificial sequence
  Synthetic sequence: human-rhesus ENaC alpha cross-reactive siRNA
  modified_base (1)..(3): um
  modified_base (6)..(6): cm
  modified_base (7)..(8): um
  modified_base (10)..(10): cm
  modified_base (13)..(14): cm
  modified_base (15)..(15): um
  modified_base (18)..(18): cm
  misc_feature (20)..(20): t is 2prime - deoxy - thymidine - 5prime - phosphorothioate
uuuaacuugcggccuggcgtt

SEQ ID NO: 54 - DNA, 21 bp, Artificial sequence
  Synthetic sequence: human-rhesus ENaC alpha cross-reactive siRNA
  modified_base (4)..(4): cm
  modified_base (11)..(11): cm
  modified_base (16)..(16): um
  misc_feature (20)..(20): t is 2prime - deoxy - thymidine - 5prime - phosphorothioate
cgccaggccgcaaguuaaatt

SEQ ID NO: 55 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (5)..(5): cm
  modified_base (7)..(7): cm
  modified_base (10)..(10): um
  modified_base (13)..(15): cm
  modified_base (16)..(16): um
  modified_base (17)..(17): cm
  misc_feature (20)..(20): t is 2prime - deoxy - thymidine - 5prime - phosphorothioate
uacucacgauggcccucggtt

SEQ ID NO: 56 - DNA, 21 bp, Artificial sequence
  Synthetic sequence: human-rhesus ENaC alpha cross-reactive siRNA
  modified_base (9)..(9): cm
  modified_base (18)..(18): um
  misc_feature (20)..(20): t is 2prime - deoxy - thymidine - 5prime - phosphorothioate
ccgagggccaucgugaguatt

SEQ ID NO: 57 - DNA, 21 bp, Artificial sequence
  Synthetic sequence: human-rhesus ENaC alpha cross-reactive siRNA
  modified_base (1)..(3): um
  modified_base (4)..(4): cm
  modified_base (11)..(11): um
  modified_base (13)..(13): cm
  modified_base (14)..(15): um
  modified_base (16)..(16): cm
  modified_base (19)..(19): cm
  misc_feature (20)..(20): t is 2prime - deoxy - thymidine - 5prime - phosphorothioate
uuucggagaguacuucagctt

SEQ ID NO: 58 - DNA, 21 bp, Artificial sequence
  Synthetic sequence: human-rhesus ENaC alpha cross-reactive siRNA
  modified_base (8)..(8): um
  misc_feature (20)..(20): t is 2prime - deoxy - thymidine - 5prime - phosphorothioate
gcugaaguacucuccgaaatt

SEQ ID NO: 59 - DNA, 21 bp, Artificial sequence
  Synthetic sequence: human-rhesus ENaC alpha cross-reactive siRNA
  modified_base (2)..(2): cm
  modified_base (6)..(6): cm
  modified_base (8)..(8): cm
  modified_base (9)..(9): um
  modified_base (10)..(10): cm
  modified_base (11)..(13): um
  modified_base (16)..(17): cm
  modified_base (18)..(18): um
  misc_feature (20)..(20): t is 2prime - deoxy - thymidine - 5prime - phosphorothioate
gcagacgcucuuugaccugtt

SEQ ID NO: 60 - DNA, 21 bp, Artificial sequence
  Synthetic sequence: human-rhesus ENaC alpha cross-reactive siRNA
  modified_base (1)..(1): cm
  modified_base (6)..(6): cm
  misc_feature (20)..(20): t is 2prime - deoxy - thymidine - 5prime - phosphorothioate
caggucaaagagcgucugctt

SEQ ID NO: 61 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(4): cm
  modified_base (6)..(6): um
  modified_base (7)..(7): cm
  modified_base (8)..(9): um
  modified_base (10)..(10): cm
  modified_base (11)..(11): um
  modified_base (13)..(13): um
  modified_base (14)..(15): cm
  modified_base (17)..(17): cm
  misc_feature (20)..(20): t is 2prime - deoxy - thymidine - 5prime - phosphorothioate
cuacaucuucuauccgcggtt

SEQ ID NO: 62 - DNA, 21 bp, Artificial sequence
  Synthetic sequence: human-rhesus ENaC alpha cross-reactive siRNA
  modified_base (8)..(8): um
  modified_base (17)..(17): um
  misc_feature (20)..(20): t is 2prime - deoxy - thymidine - 5prime - phosphorothioate
ccgcggauagaagauguagtt

SEQ ID NO: 63 - DNA, 21 bp, Artificial sequence
  Synthetic sequence: human-rhesus ENaC alpha cross-reactive siRNA
  modified_base (4)..(4): cm
  modified_base (8)..(9): um
  modified_base (11)..(11): cm
  modified_base (12)..(12): um
  modified_base (13)..(13): cm
  modified_base (14)..(14): um
  modified_base (15)..(15): cm
  modified_base (17)..(17): cm
  modified_base (18)..(19): um
  misc_feature (20)..(20): t is 2prime - deoxy - thymidine - 5prime - phosphorothioate
aggcgaauuacucucacuutt

SEQ ID NO: 64 - DNA, 21 bp, Artificial sequence
  Synthetic sequence: human-rhesus ENaC alpha cross-reactive siRNA
  modified_base (10)..(10): um
  misc_feature (20)..(20): t is 2prime - deoxy - thymidine - 5prime - phosphorothioate
aagugagaguaauucgccutt

SEQ ID NO: 65 - DNA, 21 bp, Artificial sequence
  Synthetic sequence: human-rhesus ENaC alpha cross-reactive siRNA
  modified_base (1)..(2): cm
  modified_base (4)..(4): cm
  modified_base (5)..(6): um
  modified_base (7)..(7): cm
  modified_base (10)..(11): cm
  modified_base (15)..(15): um
  modified_base (16)..(16): cm
  modified_base (17)..(17): um
  modified_base (18)..(19): cm
  misc_feature (20)..(20): t is 2prime - deoxy - thymidine - 5prime - phosphorothioate
ccgcuucaaccaggucucctt

SEQ ID NO: 66 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggagaccugguugaagcggtt

SEQ ID NO: 67 - DNA, 21 bp, Artificial sequence
  Synthetic sequence: human-rhesus ENaC alpha cross-reactive siRNA
  modified_base (1)..(1): cm
  modified_base (4)..(5): cm
  modified_base (7)..(7): cm
  modified_base (9)..(9): um
  modified_base (15)..(15): cm
  modified_base (18)..(19): cm
  misc_feature (20)..(20): t is 2prime - deoxy - thymidine - 5prime - phosphorothioate
caaccgcaugaagacggcctt

SEQ ID NO: 68 - DNA, 21 bp, Artificial sequence
  Synthetic sequence: human-rhesus ENaC alpha cross-reactive siRNA
  modified_base (10)..(10): cm
  misc_feature (20)..(20): t is 2prime - deoxy - thymidine - 5prime - phosphorothioate
ggccgucuucaugcgguugtt

SEQ ID NO: 69 - DNA, 21 bp, Artificial sequence
  Synthetic sequence: human-rhesus ENaC alpha cross-reactive siRNA
  modified_base (2)..(2): um
  modified_base (8)..(8): cm
  modified_base (11)..(12): cm
  modified_base (13)..(14): um
  modified_base (15)..(15): cm
  modified_base (16)..(16): um
  misc_feature (20)..(20): t is 2prime - deoxy - thymidine - 5prime - phosphorothioate
augaagacggccuucugggtt

SEQ ID NO: 70 - DNA, 21 bp, Artificial sequence
  Synthetic sequence: human-rhesus ENaC alpha cross-reactive siRNA
  modified_base (3)..(3): cm
  modified_base (17)..(17): cm
  misc_feature (20)..(20): t is 2prime - deoxy - thymidine - 5prime - phosphorothioate
cccagaaggccgucuucautt

SEQ ID NO: 71 - DNA, 21 bp, Artificial sequence
  Synthetic sequence: human-rhesus ENaC alpha cross-reactive siRNA
  modified_base (3)..(3): cm
  modified_base (5)..(5): cm
  modified_base (8)..(9): cm
  modified_base (11)..(11): cm
  modified_base (13)..(13): um
  modified_base (19)..(19): cm
  misc_feature (20)..(20): t is 2prime - deoxy - thymidine - 5prime - phosphorothioate
agcacaaccgcaugaagactt

SEQ ID NO: 72 - DNA, 21 bp, Artificial sequence
  Synthetic sequence: human-rhesus ENaC alpha cross-reactive siRNA
  modified_base (6)..(6): cm
  misc_feature (20)..(20): t is 2prime - deoxy - thymidine - 5prime - phosphorothioate
gucuucaugcgguugugcutt

SEQ ID NO: 73 - DNA, 21 bp, Artificial sequence
  Synthetic sequence: human-rhesus ENaC alpha cross-reactive siRNA
  modified_base (1)..(1): um
  modified_base (2)..(2): cm
  modified_base (6)..(7): um
  modified_base (8)..(9): cm
  modified_base (11)..(12): cm
  modified_base (14)..(14): cm
  modified_base (15)..(15): um
  modified_base (16)..(17): cm
  modified_base (18)..(18): um
  misc_feature (20)..(20): t is 2prime - deoxy - thymidine - 5prime - phosphorothioate
ucgaguuccaccgcuccuatt

SEQ ID NO: 74 - DNA, 21 bp, Artificial sequence
  Synthetic sequence: human-rhesus ENaC alpha cross-reactive siRNA
  modified_base (1)..(1): um
  misc_feature (20)..(20): t is 2prime - deoxy - thymidine - 5prime - phosphorothioate
uaggagcgguggaacucgatt

SEQ ID NO: 75 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(4): cm
  modified_base (5)..(6): um
  modified_base (7)..(7): cm
  modified_base (8)..(8): um
  modified_base (10)..(11): cm
  modified_base (15)..(15): cm
  modified_base (17)..(17): um
  modified_base (19)..(19): cm
  misc_feature (20)..(20): t is 2prime - deoxy - thymidine - 5prime - phosphorothioate
cugcuucuaccagacauactt

SEQ ID NO: 76 - DNA, 21 bp, Artificial sequence
  Synthetic sequence: human-rhesus ENaC alpha cross-reactive siRNA
  modified_base (2)..(2): um
  modified_base (11)..(11): um
  modified_base (17)..(17): cm
  misc_feature (20)..(20): t is 2prime - deoxy - thymidine - 5prime - phosphorothioate
guaugucugguagaagcagtt

SEQ ID NO: 77 - DNA, 21 bp, Artificial sequence
  Synthetic sequence: human-rhesus ENaC alpha cross-reactive siRNA
  modified_base (8)..(8): um
  modified_base (11)..(11): um
  modified_base (13)..(14): cm
  modified_base (16)..(16): cm
  modified_base (17)..(18): um
  modified_base (19)..(19): cm
  misc_feature (20)..(20): t is 2prime - deoxy - thymidine - 5prime - phosphorothioate
gagggagugguaccgcuuctt

SEQ ID NO: 78 - DNA, 21 bp, Artificial sequence
  Synthetic sequence: human-rhesus ENaC alpha cross-reactive siRNA
  modified_base (8)..(8): um
  modified_base (11)..(11): cm
  misc_feature (20)..(20): t is 2prime - deoxy - thymidine - 5prime - phosphorothioate
gaagcgguaccacucccuctt

SEQ ID NO: 79 - DNA, 21 bp, Artificial sequence
  Synthetic sequence: human-rhesus ENaC alpha cross-reactive siRNA
  modified_base (1)..(2): cm
  modified_base (3)..(5): um
  modified_base (7)..(7): um
  modified_base (11)..(11): um
  modified_base (14)..(14): um
  modified_base (17)..(17): um
  misc_feature (20)..(20): t is 2prime - deoxy - thymidine - 5prime - phosphorothioate
ccuuuauggaugaugguggtt

SEQ ID NO: 80 - DNA, 21 bp, Artificial sequence
  Synthetic sequence: human-rhesus ENaC alpha cross-reactive siRNA
  modified_base (2)..(2): cm
  modified_base (5)..(5): cm
  modified_base (8)..(8): cm
  modified_base (12)..(12): cm
  modified_base (14)..(14): um
  misc_feature (20)..(20): t is 2prime - deoxy - thymidine - 5prime - phosphorothioate
ccaccaucauccauaaaggtt

SEQ ID NO: 81 - DNA, 21 bp, Artificial sequence
  Synthetic sequence: human-rhesus ENaC alpha cross-reactive siRNA
  modified_base (1)..(1): um
  modified_base (9)..(9): um
  modified_base (12)..(12): um
  modified_base (14)..(15): cm
  modified_base (17)..(17): cm
  modified_base (18)..(19): um
  misc_feature (20)..(20): t is 2prime - deoxy - thymidine - 5prime - phosphorothioate
ugagggagugguaccgcuutt

SEQ ID NO: 82 - DNA, 21 bp, Artificial sequence
  Synthetic sequence: human-rhesus ENaC alpha cross-reactive siRNA
  modified_base (7)..(7): um
  modified_base (10)..(10): cm
  modified_base (18)..(18): cm
  misc_feature (20)..(20): t is 2prime - deoxy - thymidine - 5prime - phosphorothioate
aagcgguaccacucccucatt

SEQ ID NO: 83 - DNA, 21 bp, Artificial sequence
  Synthetic sequence: human-rhesus ENaC alpha cross-reactive siRNA
  modified_base (1)..(2): cm
  modified_base (3)..(3): um
  modified_base (5)..(5): cm
  modified_base (8)..(9): cm
  modified_base (13)..(13): cm
  modified_base (17)..(18): um
  misc_feature (20)..(20): t is 2prime - deoxy - thymidine - 5prime - phosphorothioate
ccugcaaccaggcgaauuatt

SEQ ID NO: 84 - DNA, 21 bp, Artificial sequence
  Synthetic sequence: human-rhesus ENaC alpha cross-reactive siRNA
  modified_base (1)..(1): um
  modified_base (16)..(16): cm
  misc_feature (20)..(20): t is 2prime - deoxy - thymidine - 5prime - phosphorothioate
uaauucgccugguugcaggtt

SEQ ID NO: 85 - DNA, 21 bp, Artificial sequence
  Synthetic sequence: human-rhesus ENaC alpha cross-reactive siRNA
  modified_base (3)..(4): cm
  modified_base (5)..(5): um
  modified_base (8)..(8): cm
  modified_base (10)..(10): um
  modified_base (16)..(17): cm
  modified_base (18)..(18): um
  modified_base (19)..(19): cm
  misc_feature (20)..(20): t is 2prime - deoxy - thymidine - 5prime - phosphorothioate
ggccuggcguggagaccuctt

SEQ ID NO: 86 - DNA, 21 bp, Artificial sequence
  Synthetic sequence: human-rhesus ENaC alpha cross-reactive siRNA
  modified_base (9)..(9): cm
  modified_base (14)..(14): cm
  misc_feature (20)..(20): t is 2prime - deoxy - thymidine - 5prime - phosphorothioate
gaggucuccacgccaggcctt

SEQ ID NO: 87 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(7): um
  modified_base (8)..(8): cm
  modified_base (15)..(15): um
  modified_base (17)..(17): cm
  modified_base (18)..(19): um
  misc_feature (20)..(20): t is 2prime - deoxy - thymidine - 5prime - phosphorothioate
ugcuuuucggagaguacuutt

SEQ ID NO: 88 - DNA, 21 bp, Artificial sequence
  Synthetic sequence: human-rhesus ENaC alpha cross-reactive siRNA
  modified_base (4)..(4): um
  modified_base (18)..(18): cm
  misc_feature (20)..(20): t is 2prime - deoxy - thymidine - 5prime - phosphorothioate
aaguacucuccgaaaagcatt

SEQ ID NO: 89 - DNA, 21 bp, Artificial sequence
  Synthetic sequence: human-rhesus ENaC alpha cross-reactive siRNA
  modified_base (1)..(3): cm
  modified_base (5)..(5): um
  modified_base (8)..(8): cm
  modified_base (10)..(10): um
  modified_base (13)..(14): cm
  modified_base (15)..(15): um
  modified_base (16)..(17): cm
  misc_feature (20)..(20): t is 2prime - deoxy - thymidine - 5prime - phosphorothioate
cccguagcguggccuccagtt

SEQ ID NO: 90 - DNA, 21 bp, Artificial sequence
  Synthetic sequence: human-rhesus ENaC alpha cross-reactive siRNA
  modified_base (9)..(9): cm
  modified_base (14)..(14): um
  misc_feature (20)..(20): t is 2prime - deoxy - thymidine - 5prime - phosphorothioate
cuggaggccacgcuacgggtt

SEQ ID NO: 91 - DNA, 21 bp, Artificial sequence
  Synthetic sequence: human-rhesus ENaC alpha cross-reactive siRNA
  modified_base (1)..(2): cm
  modified_base (4)..(4): um
  modified_base (7)..(7): cm
  modified_base (9)..(9): um
  modified_base (12)..(13): cm
  modified_base (14)..(14): um
  modified_base (15)..(16): cm
  modified_base (19)..(19): cm
  misc_feature (20)..(20): t is 2prime - deoxy - thymidine - 5prime - phosphorothioate
ccguagcguggccuccagctt

SEQ ID NO: 92 - DNA, 21 bp, Artificial sequence
  Synthetic sequence: human-rhesus ENaC alpha cross-reactive siRNA
  modified_base (10)..(10): cm
  modified_base (15)..(15): um
  misc_feature (20)..(20): t is 2prime - deoxy - thymidine - 5prime - phosphorothioate
gcuggaggccacgcuacggtt

SEQ ID NO: 93 - DNA, 21 bp, Artificial sequence
  Synthetic sequence: human-rhesus ENaC alpha cross-reactive siRNA
  modified_base (1)..(2): cm
  modified_base (6)..(6): cm
  modified_base (10)..(11): um
  modified_base (13)..(13): cm
  modified_base (14)..(14): um
  modified_base (15)..(15): cm
  modified_base (16)..(16): um
  modified_base (17)..(17): cm
  modified_base (19)..(19): cm
  misc_feature (20)..(20): t is 2prime - deoxy - thymidine - 5prime - phosphorothioate
ccaggcgaauuacucucactt

SEQ ID NO: 94 - DNA, 21 bp, Artificial sequence
  Synthetic sequence: human-rhesus ENaC alpha cross-reactive siRNA
  modified_base (8)..(8): um
  misc_feature (20)..(20): t is 2prime - deoxy - thymidine - 5prime - phosphorothioate
gugagaguaauucgccuggtt

SEQ ID NO: 95 - DNA, 21 bp, Artificial sequence
  Synthetic sequence: human-rhesus ENaC alpha cross-reactive siRNA
  modified_base (5)..(5): cm
  modified_base (6)..(6): um
  modified_base (8)..(8): cm
  modified_base (9)..(9): um
  modified_base (11)..(11): um
  modified_base (13)..(13): cm
  modified_base (14)..(16): um
  modified_base (17)..(17): cm
  misc_feature (20)..(20): t is 2prime - deoxy - thymidine - 5prime - phosphorothioate
gaaacugcuauacuuucaatt

SEQ ID NO: 96 - DNA, 21 bp, Artificial sequence
  Synthetic sequence: human-rhesus ENaC alpha cross-reactive siRNA
  modified_base (8)..(8): um
  modified_base (10)..(10): um
  modified_base (13)..(13): cm
  misc_feature (20)..(20): t is 2prime - deoxy - thymidine - 5prime - phosphorothioate
uugaaaguauagcaguuuctt

SEQ ID NO: 97 - DNA, 21 bp, Artificial sequence
  Synthetic sequence: human-rhesus ENaC alpha cross-reactive siRNA
  modified_base (2)..(4): cm
  modified_base (8)..(8): um
  modified_base (11)..(11): um
  modified_base (14)..(14): um
  modified_base (16)..(16): cm
  modified_base (18)..(18): cm
  misc_feature (20)..(20): t is 2prime - deoxy - thymidine - 5prime - phosphorothioate
gcccggguaauggugcacgtt

SEQ ID NO: 98 - DNA, 21 bp, Artificial sequence
  Synthetic sequence: human-rhesus ENaC alpha cross-reactive siRNA
  modified_base (5)..(5): cm
  modified_base (8)..(8): cm
  modified_base (11)..(11): um
  misc_feature (20)..(20): t is 2prime - deoxy - thymidine - 5prime - phosphorothioate
cgugcaccauuacccgggctt

SEQ ID NO: 99 - DNA, 21 bp, Artificial sequence
  Synthetic sequence: human-rhesus ENaC alpha cross-reactive siRNA
  modified_base (1)..(3): cm
  modified_base (7)..(7): um
  modified_base (10)..(10): um
  modified_base (13)..(13): um
  modified_base (15)..(15): cm
  modified_base (17)..(17): cm
  misc_feature (20)..(20): t is 2prime - deoxy - thymidine - 5prime - phosphorothioate
cccggguaauggugcacggtt

SEQ ID NO: 100 - DNA, 21 bp, Artificial sequence
  Synthetic sequence: human-rhesus ENaC alpha cross-reactive siRNA
  modified_base (6)..(6): cm
  modified_base (9)..(9): cm
  modified_base (12)..(12): um
  misc_feature (20)..(20): t is 2prime - deoxy - thymidine - 5prime - phosphorothioate
ccgugcaccauuacccgggtt

SEQ ID NO: 101 - DNA, 21 bp, Artificial sequence
  Synthetic sequence: human-rhesus ENaC alpha cross-reactive siRNA
  modified_base (1)..(1): cm
  modified_base (5)..(5): um
  modified_base (8)..(8): um
  modified_base (11)..(11): um
  modified_base (13)..(13): cm
  modified_base (15)..(15): cm
  modified_base (19)..(19): cm
  misc_feature (20)..(20): t is 2prime - deoxy - thymidine - 5prime - phosphorothioate
cggguaauggugcacgggctt

SEQ ID NO: 102 - DNA, 21 bp, Artificial sequence
  Synthetic sequence: human-rhesus ENaC alpha cross-reactive siRNA
  modified_base (8)..(8): cm
  modified_base (11)..(11): cm
  modified_base (14)..(14): um
  misc_feature (20)..(20): t is 2prime - deoxy - thymidine - 5prime - phosphorothioate
gcccgugcaccauuacccgtt

SEQ ID NO: 103 - DNA, 21 bp, Artificial sequence
  Synthetic sequence: human-rhesus ENaC alpha cross-reactive siRNA
  modified_base (4)..(4): um
  modified_base (7)..(7): um
  modified_base (10)..(10): um
  modified_base (12)..(12): cm
  modified_base (14)..(14): cm
  modified_base (18)..(18): cm
  misc_feature (20)..(20): t is 2prime - deoxy - thymidine - 5prime - phosphorothioate
ggguaauggugcacgggcatt

SEQ ID NO: 104 - DNA, 21 bp, Artificial sequence
  Synthetic sequence: human-rhesus ENaC alpha cross-reactive siRNA
  modified_base (9)..(9): cm
  modified_base (12)..(12): cm
  modified_base (15)..(15): um
  misc_feature (20)..(20): t is 2prime - deoxy - thymidine - 5prime - phosphorothioate
ugcccgugcaccauuaccctt

SEQ ID NO: 105 - DNA, 21 bp, Artificial sequence
  Synthetic sequence: human-rhesus ENaC alpha cross-reactive siRNA
  modified_base (1)..(1): um
  modified_base (4)..(4): um
  modified_base (7)..(7): um
  modified_base (9)..(9): cm
  modified_base (11)..(11): cm
  modified_base (15)..(15): cm
  misc_feature (20)..(20): t is 2prime - deoxy - thymidine - 5prime - phosphorothioate
uaauggugcacgggcaggatt

SEQ ID NO: 106 - DNA, 21 bp, Artificial sequence
  Synthetic sequence: human-rhesus ENaC alpha cross-reactive siRNA
  modified_base (12)..(12): cm
  modified_base (15)..(15): cm
  modified_base (18)..(18): um
  misc_feature (20)..(20): t is 2prime - deoxy - thymidine - 5prime - phosphorothioate
uccugcccgugcaccauuatt

SEQ ID NO: 107 - DNA, 21 bp, Artificial sequence
  Synthetic sequence: human-rhesus ENaC alpha cross-reactive siRNA
  modified_base (1)..(1): cm
  modified_base (2)..(2): um
  modified_base (5)..(6): um
  modified_base (8)..(8): cm
  modified_base (9)..(9): um
  modified_base (10)..(10): cm
  modified_base (12)..(12): cm
  modified_base (15)..(15): um
  modified_base (18)..(19): cm
  misc_feature (20)..(20): t is 2prime - deoxy - thymidine - 5prime - phosphorothioate
cugguuacucacgauggcctt

SEQ ID NO: 108 - DNA, 21 bp, Artificial sequence
  Synthetic sequence: human-rhesus ENaC alpha cross-reactive siRNA
  modified_base (4)..(4): cm
  modified_base (13)..(13): um
  modified_base (17)..(17): cm
  misc_feature (20)..(20): t is 2prime - deoxy - thymidine - 5prime - phosphorothioate
ggccaucgugaguaaccagtt

SEQ ID NO: 109 - DNA, 21 bp, Artificial sequence
  Synthetic sequence: human-rhesus ENaC alpha cross-reactive siRNA
  modified_base (2)..(3): um
  modified_base (5)..(5): cm
  modified_base (6)..(6): um
  modified_base (7)..(7): cm
  modified_base (9)..(9): cm
  modified_base (12)..(12): um
  modified_base (15)..(17): cm
  modified_base (18)..(18): um
  modified_base (19)..(19): cm
  misc_feature (20)..(20): t is 2prime - deoxy - thymidine - 5prime - phosphorothioate
guuacucacgauggcccuctt

SEQ ID NO: 110 - DNA, 21 bp, Artificial sequence
  Synthetic sequence: human-rhesus ENaC alpha cross-reactive siRNA
  modified_base (7)..(7): cm
  modified_base (16)..(16): um
  misc_feature (20)..(20): t is 2prime - deoxy - thymidine - 5prime - phosphorothioate
gagggccaucgugaguaactt

SEQ ID NO: 111 - DNA, 21 bp, Artificial sequence
  Synthetic sequence: human-rhesus ENaC alpha cross-reactive siRNA
  modified_base (1)..(1): um
  modified_base (3)..(3): um
  modified_base (4)..(4): cm
  modified_base (6)..(6): cm
  modified_base (9)..(9): um
  modified_base (12)..(12): um
  modified_base (13)..(13): cm
  modified_base (15)..(17): cm
  modified_base (18)..(18): um
  modified_base (19)..(19): cm
  misc_feature (20)..(20): t is 2prime - deoxy - thymidine - 5prime - phosphorothioate
ugucacgauggucacccuctt

SEQ ID NO: 112 - DNA, 21 bp, Artificial sequence
  Synthetic sequence: human-rhesus ENaC alpha cross-reactive siRNA
  modified_base (10)..(10): cm
  modified_base (18)..(18): cm
  misc_feature (20)..(20): t is 2prime - deoxy - thymidine - 5prime - phosphorothioate
gagggugaccaucgugacatt

SEQ ID NO: 113 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (5)..(6): cm
  modified_base (12)..(13): um
  modified_base (14)..(15): cm
  misc_feature (20)..(20): t is 2prime - deoxy - thymidine - 5prime - phosphorothioate
ugcuccgaagguuccgaagtt

SEQ ID NO: 114 - DNA, 21 bp, Artificial sequence
  Synthetic sequence: human-rhesus ENaC alpha cross-reactive siRNA
  modified_base (18)..(18): cm
  misc_feature (20)..(20): t is 2prime - deoxy - thymidine - 5prime - phosphorothioate
cuucggaaccuucggagcatt

SEQ ID NO: 115 - DNA, 21 bp, Artificial sequence
  Synthetic sequence: human-rhesus ENaC alpha cross-reactive siRNA
  modified_base (1)..(1): um
  modified_base (2)..(3): cm
  modified_base (9)..(10): um
  modified_base (11)..(12): cm
  modified_base (17)..(18): cm
  misc_feature (20)..(20): t is 2prime - deoxy - thymidine - 5prime - phosphorothioate
uccgaagguuccgaagccgtt

SEQ ID NO: 116 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cggcuucggaaccuucggatt

SEQ ID NO: 117 - DNA, 21 bp, Artificial sequence
  Synthetic sequence: human-rhesus ENaC alpha cross-reactive siRNA
  modified_base (1)..(2): um
  modified_base (3)..(4): cm
  modified_base (9)..(10): cm
  modified_base (13)..(13): um
  modified_base (15)..(15): cm
  modified_base (16)..(16): um
  modified_base (19)..(19): um
  misc_feature (20)..(20): t is 2prime - deoxy - thymidine - 5prime - phosphorothioate
uuccgaagccgauacuggutt

SEQ ID NO: 118 - DNA, 21 bp, Artificial sequence
  Synthetic sequence: human-rhesus ENaC alpha cross-reactive siRNA
  modified_base (3)..(3): cm
  modified_base (6)..(6): um
  misc_feature (20)..(20): t is 2prime - deoxy - thymidine - 5prime - phosphorothioate
accaguaucggcuucggaatt

SEQ ID NO: 119 - DNA, 21 bp, Artificial sequence
  Synthetic sequence: human-rhesus ENaC alpha cross-reactive siRNA
  modified_base (3)..(4): cm
  modified_base (7)..(7): um
  modified_base (9)..(9): cm
  modified_base (10)..(10): um
  modified_base (13)..(13): um
  modified_base (14)..(14): cm
  modified_base (15)..(15): um
  modified_base (16)..(17): cm
  misc_feature (20)..(20): t is 2prime - deoxy - thymidine - 5prime - phosphorothioate
agccgauacuggucuccagtt

SEQ ID NO: 120 - DNA, 21 bp, Artificial sequence
  Synthetic sequence: human-rhesus ENaC alpha cross-reactive siRNA
  modified_base (9)..(9): cm
  modified_base (12)..(12): um
  misc_feature (20)..(20): t is 2prime - deoxy - thymidine - 5prime - phosphorothioate
cuggagaccaguaucggcutt

SEQ ID NO: 121 - DNA, 21 bp, Artificial sequence
  Synthetic sequence: human-rhesus ENaC alpha cross-reactive siRNA
  modified_base (1)..(1): cm
  modified_base (2)..(3): um
  modified_base (6)..(6): um
  modified_base (8)..(8): cm
  modified_base (9)..(9): um
  modified_base (11)..(12): cm
  modified_base (13)..(13): um
  modified_base (14)..(14): cm
  modified_base (15)..(15): um
  modified_base (19)..(19): cm
  misc_feature (20)..(20): t is 2prime - deoxy - thymidine - 5prime - phosphorothioate
cuugguacugccucugaactt

SEQ ID NO: 122 - DNA, 21 bp, Artificial sequence
  Synthetic sequence: human-rhesus ENaC alpha cross-reactive siRNA
  modified_base (4)..(4): cm
  modified_base (10)..(10): cm
  modified_base (13)..(13): um
  modified_base (16)..(16): cm
  misc_feature (20)..(20): t is 2prime - deoxy - thymidine - 5prime - phosphorothioate
guucagaggcaguaccaagtt

SEQ ID NO: 123 - DNA, 21 bp, Artificial sequence
  Synthetic sequence: human-rhesus ENaC alpha cross-reactive siRNA
  modified_base (1)..(1): cm
  modified_base (2)..(2): um
  modified_base (3)..(5): cm
  modified_base (7)..(7): um
  modified_base (10)..(10): cm
  modified_base (12)..(12): cm
  modified_base (14)..(14): cm
  modified_base (15)..(15): um
  modified_base (17)..(17): um
  misc_feature (20)..(20): t is 2prime - deoxy - thymidine - 5prime - phosphorothioate
cucccguagcacacuauaatt

SEQ ID NO: 124 - DNA, 21 bp, Artificial sequence
  Synthetic sequence: human-rhesus ENaC alpha cross-reactive siRNA
  modified_base (2)..(2): um
  modified_base (4)..(4): um
  modified_base (12)..(12): um
  misc_feature (20)..(20): t is 2prime - deoxy - thymidine - 5prime - phosphorothioate
uuauagugugcuacgggagtt

SEQ ID NO: 125 - DNA, 21 bp, Artificial sequence
  Synthetic sequence: human-rhesus ENaC alpha cross-reactive siRNA
  modified_base (1)..(1): um
  modified_base (2)..(4): cm
  modified_base (6)..(6): um
  modified_base (9)..(9): cm
  modified_base (11)..(11): cm
  modified_base (13)..(13): cm
  modified_base (14)..(14): um
  modified_base (16)..(16): um
  modified_base (19)..(19): cm
  misc_feature (20)..(20): t is 2prime - deoxy - thymidine - 5prime - phosphorothioate
ucccguagcacacuauaactt

SEQ ID NO: 126 - DNA, 21 bp, Artificial sequence
  Synthetic sequence: human-rhesus ENaC alpha cross-reactive siRNA
  modified_base (3)..(3): um
  modified_base (5)..(5): um
  modified_base (13)..(13): um
  misc_feature (20)..(20): t is 2prime - deoxy - thymidine - 5prime - phosphorothioate
guuauagugugcuacgggatt

SEQ ID NO: 127 - DNA, 21 bp, Artificial sequence
  Synthetic sequence: human-rhesus ENaC alpha cross-reactive siRNA
  modified_base (1)..(1): um
  modified_base (3)..(3): cm
  modified_base (5)..(6): cm
  modified_base (8)..(8): um
  modified_base (10)..(10): cm
  modified_base (11)..(13): um
  modified_base (14)..(14): cm
  modified_base (15)..(16): um
  modified_base (18)..(18): um
  misc_feature (20)..(20): t is 2prime - deoxy - thymidine - 5prime - phosphorothioate
ugcaccauacuuucuuguatt

SEQ ID NO: 128 - DNA, 21 bp, Artificial sequence
  Synthetic sequence: human-rhesus ENaC alpha cross-reactive siRNA
  modified_base (1)..(1): um
  modified_base (3)..(3): cm
  modified_base (11)..(11): um
  modified_base (18)..(18): cm
  misc_feature (20)..(20): t is 2prime - deoxy - thymidine - 5prime - phosphorothioate
uacaagaaaguauggugcatt

SEQ ID NO: 129 - DNA, 21 bp, Artificial sequence
  Synthetic sequence: human-rhesus ENaC alpha cross-reactive siRNA
  modified_base (1)..(2): um
  modified_base (4)..(6): cm
  modified_base (8)..(10): um
  modified_base (12)..(12): um
  modified_base (14)..(14): um
  modified_base (16)..(16): um
  modified_base (18)..(18): cm
  modified_base (19)..(19): um
  misc_feature (20)..(20): t is 2prime - deoxy - thymidine - 5prime - phosphorothioate
uugcccguuuauguaugcutt

SEQ ID NO: 130 - DNA, 21 bp, Artificial sequence
  Synthetic sequence: human-rhesus ENaC alpha cross-reactive siRNA
  modified_base (3)..(3): cm
  modified_base (5)..(5): um
  modified_base (7)..(7): cm
  modified_base (9)..(9): um
  modified_base (17)..(17): cm
  misc_feature (20)..(20): t is 2prime - deoxy - thymidine - 5prime - phosphorothioate
agcauacauaaacgggcaatt

SEQ ID NO: 131 - DNA, 21 bp, Artificial sequence
  Synthetic sequence: human-rhesus ENaC alpha cross-reactive siRNA
  modified_base (1)..(1): um
  modified_base (3)..(5): cm
  modified_base (7)..(9): um
  modified_base (11)..(11): um
  modified_base (13)..(13): um
  modified_base (15)..(15): um
  modified_base (17)..(17): cm
  modified_base (18)..(18): um
  modified_base (19)..(19): cm
  misc_feature (20)..(20): t is 2prime - deoxy - thymidine - 5prime - phosphorothioate
ugcccguuuauguaugcuctt

SEQ ID NO: 132 - DNA, 21 bp, Artificial sequence
  Synthetic sequence: human-rhesus ENaC alpha cross-reactive siRNA
  modified_base (4)..(4): cm
  modified_base (6)..(6): um
  modified_base (8)..(8): cm
  modified_base (10)..(10): um
  modified_base (18)..(18): cm
  misc_feature (20)..(20): t is 2prime - deoxy - thymidine - 5prime - phosphorothioate
gagcauacauaaacgggcatt

SEQ ID NO: 133 - DNA, 21 bp, Artificial sequence
  Synthetic sequence: human-rhesus ENaC alpha cross-reactive siRNA
  modified_base (4)..(6): cm
  modified_base (7)..(7): um
  modified_base (11)..(12): cm
  modified_base (13)..(13): um
  modified_base (14)..(14): cm
  modified_base (15)..(15): um
  modified_base (17)..(17): cm
  misc_feature (20)..(20): t is 2prime - deoxy - thymidine - 5prime - phosphorothioate
ggacccuagaccucugcagtt

SEQ ID NO: 134 - DNA, 21 bp, Artificial sequence
  Synthetic sequence: human-rhesus ENaC alpha cross-reactive siRNA
  modified_base (4)..(4): cm
  modified_base (12)..(12): um
  misc_feature (20)..(20): t is 2prime - deoxy - thymidine - 5prime - phosphorothioate
cugcagaggucuagggucctt

SEQ ID NO: 135 - DNA, 21 bp, Artificial sequence
  Synthetic sequence: human-rhesus ENaC alpha cross-reactive siRNA
  modified_base (1)..(2): cm
  modified_base (3)..(3): um
  modified_base (7)..(8): cm
  modified_base (9)..(9): um
  modified_base (10)..(10): cm
  modified_base (11)..(11): um
  modified_base (13)..(13): cm
  modified_base (16)..(18): cm
  misc_feature (20)..(20): t is 2prime - deoxy - thymidine - 5prime - phosphorothioate
ccuagaccucugcagcccatt

SEQ ID NO: 136 - DNA, 21 bp, Artificial sequence
  Synthetic sequence: human-rhesus ENaC alpha cross-reactive siRNA
  modified_base (8)..(8): cm
  modified_base (16)..(16): um
  misc_feature (20)..(20): t is 2prime - deoxy - thymidine - 5prime - phosphorothioate
ugggcugcagaggucuaggtt

SEQ ID NO: 137 - DNA, 21 bp, Artificial sequence
  Synthetic sequence: human-rhesus ENaC alpha cross-reactive siRNA
  modified_base (1)..(1): um
  modified_base (4)..(4): cm
  modified_base (6)..(6): um
  modified_base (9)..(9): um
  modified_base (11)..(11): um
  modified_base (13)..(13): cm
  modified_base (14)..(14): um
  modified_base (17)..(17): cm
  misc_feature (20)..(20): t is 2prime - deoxy - thymidine - 5prime - phosphorothioate
uggcaugauguacuggcaatt

SEQ ID NO: 138 - DNA, 21 bp, Artificial sequence
  Synthetic sequence: human-rhesus ENaC alpha cross-reactive siRNA
  modified_base (5)..(5): cm
  modified_base (8)..(8): um
  modified_base (10)..(10): cm
  modified_base (13)..(13): cm
  modified_base (18)..(18): cm
  misc_feature (20)..(20): t is 2prime - deoxy - thymidine - 5prime - phosphorothioate
uugccaguacaucaugccatt

SEQ ID NO: 139 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (7)..(7): cm
  modified_base (10)..(11): um
  modified_base (12)..(12): cm
  modified_base (15)..(16): cm
  modified_base (17)..(17): um
  modified_base (19)..(19): cm
  misc_feature (20)..(20): t is 2prime - deoxy - thymidine - 5prime - phosphorothioate
uacuggcaauucggccugctt

SEQ ID NO: 140 - DNA, 21 bp, Artificial sequence
  Synthetic sequence: human-rhesus ENaC alpha cross-reactive siRNA
  modified_base (2)..(2): cm
  modified_base (15)..(15): cm
  modified_base (18)..(18): um
  misc_feature (20)..(20): t is 2prime - deoxy - thymidine - 5prime - phosphorothioate
gcaggccgaauugccaguatt

SEQ ID NO: 141 - DNA, 21 bp, Artificial sequence
  Synthetic sequence: human-rhesus ENaC alpha cross-reactive siRNA
  modified_base (3)..(4): um
  modified_base (5)..(5): cm
  modified_base (8)..(9): cm
  modified_base (10)..(10): um
  modified_base (12)..(12): cm
  modified_base (13)..(16): um
  modified_base (17)..(17): cm
  misc_feature (20)..(20): t is 2prime - deoxy - thymidine - 5prime - phosphorothioate
aauucggccugcuuuucggtt

SEQ ID NO: 142 - DNA, 21 bp, Artificial sequence
  Synthetic sequence: human-rhesus ENaC alpha cross-reactive siRNA
  modified_base (9)..(9): cm
  misc_feature (20)..(20): t is 2prime - deoxy - thymidine - 5prime - phosphorothioate
ccgaaaagcaggccgaauutt

SEQ ID NO: 143 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(4): cm
  modified_base (5)..(8): um
  modified_base (9)..(9): cm
  modified_base (16)..(16): um
  modified_base (18)..(18): cm
  modified_base (19)..(19): um
  misc_feature (20)..(20): t is 2prime - deoxy - thymidine - 5prime - phosphorothioate
cugcuuuucggagaguacutt

SEQ ID NO: 144 - DNA, 21 bp, Artificial sequence
  Synthetic sequence: human-rhesus ENaC alpha cross-reactive siRNA
  modified_base (3)..(3): um
  modified_base (17)..(17): cm
  misc_feature (20)..(20): t is 2prime - deoxy - thymidine - 5prime - phosphorothioate
aguacucuccgaaaagcagtt

SEQ ID NO: 145 - DNA, 21 bp, Artificial sequence
  Synthetic sequence: human-rhesus ENaC alpha cross-reactive siRNA
  modified_base (1)..(2): um
  modified_base (3)..(3): cm
  modified_base (10)..(10): um
  modified_base (12)..(12): cm
  modified_base (13)..(14): um
  modified_base (15)..(15): cm
  modified_base (18)..(18): cm
  modified_base (19)..(19): um
  misc_feature (20)..(20): t is 2prime - deoxy - thymidine - 5prime - phosphorothioate
uucggagaguacuucagcutt

SEQ ID NO: 146 - DNA, 21 bp, Artificial sequence
  Synthetic sequence: human-rhesus ENaC alpha cross-reactive siRNA
  modified_base (9)..(9): um
  misc_feature (20)..(20): t is 2prime - deoxy - thymidine - 5prime - phosphorothioate
agcugaaguacucuccgaatt

SEQ ID NO: 147 - DNA, 21 bp, Artificial sequence
  Synthetic sequence: human-rhesus ENaC alpha cross-reactive siRNA
  modified_base (3)..(3): cm
  modified_base (7)..(7): cm
  modified_base (9)..(9): cm
  modified_base (10)..(10): um
  modified_base (11)..(11): cm
  modified_base (12)..(14): um
  modified_base (17)..(18): cm
  modified_base (19)..(19): um
  misc_feature (20)..(20): t is 2prime - deoxy - thymidine - 5prime - phosphorothioate
agcagacgcucuuugaccutt

SEQ ID NO: 148 - DNA, 21 bp, Artificial sequence
  Synthetic sequence: human-rhesus ENaC alpha cross-reactive siRNA
  modified_base (5)..(5): cm
  misc_feature (20)..(20): t is 2prime - deoxy - thymidine - 5prime - phosphorothioate
aggucaaagagcgucugcutt

SEQ ID NO: 149 - DNA, 21 bp, Artificial sequence
  Synthetic sequence: human-rhesus ENaC alpha cross-reactive siRNA
  modified_base (1)..(1): cm
  modified_base (2)..(3): um
  modified_base (5)..(5): cm
  modified_base (8)..(8): cm
  modified_base (10)..(11): cm
  modified_base (12)..(12): um
  modified_base (18)..(18): um
  modified_base (19)..(19): cm
  misc_feature (20)..(20): t is 2prime - deoxy - thymidine - 5prime - phosphorothioate
cuugcagcgccugaggguctt

SEQ ID NO: 150 - DNA, 21 bp, Artificial sequence
  Synthetic sequence: human-rhesus ENaC alpha cross-reactive siRNA
  modified_base (7)..(7): cm
  modified_base (16)..(16): cm
  misc_feature (20)..(20): t is 2prime - deoxy - thymidine - 5prime - phosphorothioate
gacccucaggcgcugcaagtt

SEQ ID NO: 151 - DNA, 21 bp, Artificial sequence
  Synthetic sequence: human-rhesus ENaC alpha cross-reactive siRNA
  modified_base (1)..(1): um
  modified_base (4)..(4): cm
  modified_base (5)..(7): um
  modified_base (10)..(10): cm
  modified_base (11)..(12): um
  modified_base (14)..(14): cm
  modified_base (17)..(18): cm
  modified_base (19)..(19): um
  misc_feature (20)..(20): t is 2prime - deoxy - thymidine - 5prime - phosphorothioate
uggcuuuaacuugcggccutt

SEQ ID NO: 152 - DNA, 21 bp, Artificial sequence
  Synthetic sequence: human-rhesus ENaC alpha cross-reactive siRNA
  modified_base (7)..(7): cm
  modified_base (12)..(12): um
  modified_base (18)..(18): cm
  misc_feature (20)..(20): t is 2prime - deoxy - thymidine - 5prime - phosphorothioate
aggccgcaaguuaaagccatt

SEQ ID NO: 153 - DNA, 21 bp, Artificial sequence
  Synthetic sequence: human-rhesus ENaC alpha cross-reactive siRNA
  modified_base (2)..(2): cm
  modified_base (3)..(5): um
  modified_base (8)..(8): cm
  modified_base (9)..(10): um
  modified_base (12)..(12): cm
  modified_base (15)..(16): cm
  modified_base (17)..(17): um
  misc_feature (20)..(20): t is 2prime - deoxy - thymidine - 5prime - phosphorothioate
gcuuuaacuugcggccuggtt

SEQ ID NO: 154 - DNA, 21 bp, Artificial sequence
  Synthetic sequence: human-rhesus ENaC alpha cross-reactive siRNA
  modified_base (2)..(2): cm
  modified_base (9)..(9): cm
  modified_base (14)..(14): um
  misc_feature (20)..(20): t is 2prime - deoxy - thymidine - 5prime - phosphorothioate
ccaggccgcaaguuaaagctt

SEQ ID NO: 155 - DNA, 21 bp, Artificial sequence
  Synthetic sequence: human-rhesus ENaC alpha cross-reactive siRNA
  modified_base (1)..(1): um
  modified_base (4)..(4): cm
  modified_base (5)..(6): um
  modified_base (8)..(8): cm
  modified_base (11)..(12): cm
  modified_base (13)..(13): um
  modified_base (16)..(16): cm
  modified_base (18)..(18): um
  misc_feature (20)..(20): t is 2prime - deoxy - thymidine - 5prime - phosphorothioate
uaacuugcggccuggcgugtt

SEQ ID NO: 156 - DNA, 21 bp, Artificial sequence
  Synthetic sequence: human-rhesus ENaC alpha cross-reactive siRNA
  modified_base (1)..(1): cm
  modified_base (6)..(6): cm
  modified_base (13)..(13): cm
  modified_base (18)..(18): um
  misc_feature (20)..(20): t is 2prime - deoxy - thymidine - 5prime - phosphorothioate
cacgccaggccgcaaguuatt

SEQ ID NO: 157 - DNA, 21 bp, Artificial sequence
  Synthetic sequence: human-rhesus ENaC alpha cross-reactive siRNA
  modified_base (2)..(3): cm
  modified_base (4)..(6): um
  modified_base (8)..(10): cm
  modified_base (11)..(12): um
  modified_base (13)..(13): cm
  modified_base (18)..(18): um
  misc_feature (20)..(20): t is 2prime - deoxy - thymidine - 5prime - phosphorothioate
accuuuacccuucaaaguatt

SEQ ID NO: 158 - DNA, 21 bp, Artificial sequence
  Synthetic sequence: human-rhesus ENaC alpha cross-reactive siRNA
  modified_base (1)..(1): um
  modified_base (13)..(13): um
  misc_feature (20)..(20): t is 2prime - deoxy - thymidine - 5prime - phosphorothioate
uacuuugaaggguaaaggutt

SEQ ID NO: 159 - DNA, 21 bp, Artificial sequence
  Synthetic sequence: human-rhesus ENaC alpha cross-reactive siRNA
  modified_base (3)..(4): um
  modified_base (6)..(6): cm
  modified_base (7)..(7): um
  modified_base (8)..(8): cm
  modified_base (10)..(10): cm
  modified_base (13)..(13): um
  modified_base (16)..(18): cm
  modified_base (19)..(19): um
  misc_feature (20)..(20): t is 2prime - deoxy - thymidine - 5prime - phosphorothioate
gguuacucacgauggcccutt

SEQ ID NO: 160 - DNA, 21 bp, Artificial sequence
  Synthetic sequence: human-rhesus ENaC alpha cross-reactive siRNA
  modified_base (6)..(6): cm
  modified_base (15)..(15): um
  misc_feature (20)..(20): t is 2prime - deoxy - thymidine - 5prime - phosphorothioate
agggccaucgugaguaacctt

SEQ ID NO: 161 - DNA, 21 bp, Artificial sequence
  Synthetic sequence: human-rhesus ENaC alpha cross-reactive siRNA
  modified_base (1)..(1): cm
  modified_base (3)..(3): cm
  modified_base (6)..(6): um
  modified_base (9)..(11): cm
  modified_base (12)..(12): um
  modified_base (13)..(13): cm
  modified_base (16)..(16): um
  modified_base (19)..(19): cm
  misc_feature (20)..(20): t is 2prime - deoxy - thymidine - 5prime - phosphorothioate
cacgauggcccucggugactt

SEQ ID NO: 162 - DNA, 21 bp, Artificial sequence
  Synthetic sequence: human-rhesus ENaC alpha cross-reactive siRNA
  modified_base (3)..(3): cm
  modified_base (13)..(13): cm
  misc_feature (20)..(20): t is 2prime - deoxy - thymidine - 5prime - phosphorothioate
gucaccgagggccaucgugtt

SEQ ID NO: 163 - DNA, 21 bp, Artificial sequence
  Synthetic sequence: human-rhesus ENaC alpha cross-reactive siRNA
  modified_base (4)..(4): um
  modified_base (6)..(6): cm
  modified_base (7)..(7): um
  modified_base (9)..(9): um
  modified_base (10)..(10): cm
  modified_base (12)..(12): cm
  modified_base (15)..(15): cm
  misc_feature (20)..(20): t is 2prime - deoxy - thymidine - 5prime - phosphorothioate
agaugcuaucgcgacagaatt

SEQ ID NO: 164 - DNA, 21 bp, Artificial sequence
  Synthetic sequence: human-rhesus ENaC alpha cross-reactive siRNA
  modified_base (12)..(12): um
  modified_base (15)..(15): cm
  misc_feature (20)..(20): t is 2prime - deoxy - thymidine - 5prime - phosphorothioate
uucugucgcgauagcaucutt

SEQ ID NO: 165 - DNA, 21 bp, Artificial sequence
  Synthetic sequence: human-rhesus ENaC alpha cross-reactive siRNA
  modified_base (2)..(2): cm
  modified_base (5)..(5): um
  modified_base (8)..(8): um
  modified_base (9)..(9): cm
  modified_base (11)..(13): cm
  modified_base (14)..(14): um
  modified_base (15)..(16): cm
  modified_base (17)..(17): um
  modified_base (19)..(19): um
  misc_feature (20)..(20): t is 2prime - deoxy - thymidine - 5prime - phosphorothioate
acgauggucacccuccugutt

SEQ ID NO: 166 - DNA, 21 bp, Artificial sequence
  Synthetic sequence: human-rhesus ENaC alpha cross-reactive siRNA
  modified_base (2)..(2): cm
  modified_base (14)..(14): cm
  misc_feature (20)..(20): t is 2prime - deoxy - thymidine - 5prime - phosphorothioate
acaggagggugaccaucgutt

SEQ ID NO: 167 - DNA, 21 bp, Artificial sequence
  Synthetic sequence: human-rhesus ENaC alpha cross-reactive siRNA
  modified_base (1)..(1): cm
  modified_base (2)..(2): um
  modified_base (3)..(4): cm
  modified_base (10)..(11): um
  modified_base (12)..(13): cm
  modified_base (18)..(19): cm
  misc_feature (20)..(20): t is 2prime - deoxy - thymidine - 5prime - phosphorothioate
cuccgaagguuccgaagcctt

SEQ ID NO: 168 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcuucggaaccuucggagtt

SEQ ID NO: 169 - DNA, 21 bp, Artificial sequence
  Synthetic sequence: human-rhesus ENaC alpha cross-reactive siRNA
  modified_base (5)..(6): um
  modified_base (7)..(8): cm
  modified_base (13)..(14): cm
  modified_base (17)..(17): um
  modified_base (19)..(19): cm
  misc_feature (20)..(20): t is 2prime - deoxy - thymidine - 5prime - phosphorothioate
aagguuccgaagccgauactt

SEQ ID NO: 170 - DNA, 21 bp, Artificial sequence
  Synthetic sequence: human-rhesus ENaC alpha cross-reactive siRNA
  modified_base (2)..(2): um
  misc_feature (20)..(20): t is 2prime - deoxy - thymidine - 5prime - phosphorothioate
guaucggcuucggaaccuutt

SEQ ID NO: 171 - DNA, 21 bp, Artificial sequence
  Synthetic sequence: human-rhesus ENaC alpha cross-reactive siRNA
  modified_base (3)..(3): um
  modified_base (5)..(5): cm
  modified_base (6)..(6): um
  modified_base (8)..(9): cm
  modified_base (10)..(10): um
  modified_base (11)..(11): cm
  modified_base (12)..(12): um
  modified_base (16)..(16): cm
  modified_base (18)..(18): cm
  modified_base (19)..(19): um
  misc_feature (20)..(20): t is 2prime - deoxy - thymidine - 5prime - phosphorothioate
gguacugccucugaacacutt

SEQ ID NO: 172 - DNA, 21 bp, Artificial sequence
  Synthetic sequence: human-rhesus ENaC alpha cross-reactive siRNA
  modified_base (7)..(7): cm
  modified_base (13)..(13): cm
  modified_base (16)..(16): um
  misc_feature (20)..(20): t is 2prime - deoxy - thymidine - 5prime - phosphorothioate
aguguucagaggcaguacctt

SEQ ID NO: 173 - DNA, 21 bp, Artificial sequence
  Synthetic sequence: human-rhesus ENaC alpha cross-reactive siRNA
  modified_base (3)..(3): cm
  modified_base (4)..(6): um
  modified_base (9)..(9): cm
  modified_base (16)..(16): cm
  modified_base (17)..(19): um
  misc_feature (20)..(20): t is 2prime - deoxy - thymidine - 5prime - phosphorothioate
agcuuugacaaggaacuuutt

SEQ ID NO: 174 - DNA, 21 bp, Artificial sequence
  Synthetic sequence: human-rhesus ENaC alpha cross-reactive siRNA
  modified_base (13)..(13): cm
  misc_feature (20)..(20): t is 2prime - deoxy - thymidine - 5prime - phosphorothioate
aaaguuccuugucaaagcutt

SEQ ID NO: 175 - DNA, 21 bp, Artificial sequence
  Synthetic sequence: human-rhesus ENaC alpha cross-reactive siRNA
  modified_base (1)..(3): um
  modified_base (6)..(6): cm
  modified_base (13)..(13): cm
  modified_base (14)..(16): um
  modified_base (17)..(18): cm
  modified_base (19)..(19): um
  misc_feature (20)..(20): t is 2prime - deoxy - thymidine - 5prime - phosphorothioate
uuugacaaggaacuuuccutt

SEQ ID NO: 176 - DNA, 21 bp, Artificial sequence
  Synthetic sequence: human-rhesus ENaC alpha cross-reactive siRNA
  modified_base (16)..(16): cm
  misc_feature (20)..(20): t is 2prime - deoxy - thymidine - 5prime - phosphorothioate
aggaaaguuccuugucaaatt

SEQ ID NO: 177 - DNA, 21 bp, Artificial sequence
  Synthetic sequence: human-rhesus ENaC alpha cross-reactive siRNA
  modified_base (1)..(1): um
  modified_base (4)..(4): cm
  modified_base (11)..(11): cm
  modified_base (12)..(14): um
  modified_base (15)..(16): cm
  modified_base (17)..(17): um
  misc_feature (20)..(20): t is 2prime - deoxy - thymidine - 5prime - phosphorothioate
ugacaaggaacuuuccuaatt

SEQ ID NO: 178 - DNA, 21 bp, Artificial sequence
  Synthetic sequence: human-rhesus ENaC alpha cross-reactive siRNA
  modified_base (2)..(2): um
  modified_base (18)..(18): cm
  misc_feature (20)..(20): t is 2prime - deoxy - thymidine - 5prime - phosphorothioate
uuaggaaaguuccuugucatt

SEQ ID NO: 179 - DNA, 21 bp, Artificial sequence
  Synthetic sequence: human-rhesus ENaC alpha cross-reactive siRNA
  modified_base (1)..(3): cm
  modified_base (5)..(5): um
  modified_base (8)..(8): cm
  modified_base (10)..(10): cm
  modified_base (12)..(12): cm
  modified_base (13)..(13): um
  modified_base (15)..(15): um
  modified_base (18)..(18): cm
  misc_feature (20)..(20): t is 2prime - deoxy - thymidine - 5prime - phosphorothioate
cccguagcacacuauaacatt

SEQ ID NO: 180 - DNA, 21 bp, Artificial sequence
  Synthetic sequence: human-rhesus ENaC alpha cross-reactive siRNA
  modified_base (4)..(4): um
  modified_base (6)..(6): um
  modified_base (14)..(14): um
  misc_feature (20)..(20): t is 2prime - deoxy - thymidine - 5prime - phosphorothioate
uguuauagugugcuacgggtt

SEQ ID NO: 181 - DNA, 21 bp, Artificial sequence
  Synthetic sequence: human-rhesus ENaC alpha cross-reactive siRNA
  modified_base (1)..(1): cm
  modified_base (3)..(3): cm
  modified_base (4)..(4): um
  modified_base (6)..(6): um
  modified_base (9)..(9): cm
  modified_base (11)..(11): um
  modified_base (12)..(12): cm
  modified_base (13)..(13): um
  modified_base (15)..(15): cm
  modified_base (16)..(16): um
  misc_feature (20)..(20): t is 2prime - deoxy - thymidine - 5prime - phosphorothioate
cacuauaacaucugcuggatt

SEQ ID NO: 182 - DNA, 21 bp, Artificial sequence
  Synthetic sequence: human-rhesus ENaC alpha cross-reactive siRNA
  modified_base (3)..(3): cm
  modified_base (6)..(6): cm
  modified_base (13)..(13): um
  modified_base (15)..(15): um
  misc_feature (20)..(20): t is 2prime - deoxy - thymidine - 5prime - phosphorothioate
uccagcagauguuauagugtt

SEQ ID NO: 183 - DNA, 21 bp, Artificial sequence
  Synthetic sequence: human-rhesus ENaC alpha cross-reactive siRNA
  modified_base (1)..(2): um
  modified_base (4)..(4): cm
  modified_base (5)..(5): um
  modified_base (7)..(8): um
  modified_base (10)..(10): cm
  modified_base (12)..(13): cm
  modified_base (15)..(15): um
  modified_base (17)..(17): cm
  modified_base (18)..(19): um
  misc_feature (20)..(20): t is 2prime - deoxy - thymidine - 5prime - phosphorothioate
uugcuguugcaccauacuutt

SEQ ID NO: 184 - DNA, 21 bp, Artificial sequence
  Synthetic sequence: human-rhesus ENaC alpha cross-reactive siRNA
  modified_base (4)..(4): um
  modified_base (11)..(11): cm
  modified_base (14)..(14): cm
  modified_base (17)..(17): cm
  misc_feature (20)..(20): t is 2prime - deoxy - thymidine - 5prime - phosphorothioate
aaguauggugcaacagcaatt

SEQ ID NO: 185 - DNA, 21 bp, Artificial sequence
  Synthetic sequence: human-rhesus ENaC alpha cross-reactive siRNA
  modified_base (2)..(2): um
  modified_base (4)..(4): cm
  modified_base (5)..(5): um
  modified_base (8)..(8): cm
  modified_base (11)..(12): um
  modified_base (13)..(13): cm
  modified_base (16)..(17): cm
  modified_base (18)..(18): um
  misc_feature (20)..(20): t is 2prime - deoxy - thymidine - 5prime - phosphorothioate
guacuggcaauucggccugtt

SEQ ID NO: 186 - DNA, 21 bp, Artificial sequence
  Synthetic sequence: human-rhesus ENaC alpha cross-reactive siRNA
  modified_base (1)..(1): cm
  modified_base (14)..(14): cm
  modified_base (17)..(17): um
  misc_feature (20)..(20): t is 2prime - deoxy - thymidine - 5prime - phosphorothioate
caggccgaauugccaguactt

SEQ ID NO: 187 - DNA, 21 bp, Artificial sequence
  Synthetic sequence: human-rhesus ENaC alpha cross-reactive siRNA
  modified_base (1)..(2): um
  modified_base (3)..(3): cm
  modified_base (6)..(7): cm
  modified_base (8)..(8): um
  modified_base (10)..(10): cm
  modified_base (11)..(14): um
  modified_base (15)..(15): cm
  misc_feature (20)..(20): t is 2prime - deoxy - thymidine - 5prime - phosphorothioate
uucggccugcuuuucggagtt

SEQ ID NO: 188 - DNA, 21 bp, Artificial sequence
  Synthetic sequence: human-rhesus ENaC alpha cross-reactive siRNA
  modified_base (11)..(11): cm
  misc_feature (20)..(20): t is 2prime - deoxy - thymidine - 5prime - phosphorothioate
cuccgaaaagcaggccgaatt

SEQ ID NO: 189 - DNA, 21 bp, Artificial sequence
  Synthetic sequence: human-rhesus ENaC alpha cross-reactive siRNA
  modified_base (1)..(2): cm
  modified_base (3)..(3): um
  modified_base (5)..(5): cm
  modified_base (6)..(9): um
  modified_base (10)..(10): cm
  modified_base (17)..(17): um
  modified_base (19)..(19): cm
  misc_feature (20)..(20): t is 2prime - deoxy - thymidine - 5prime - phosphorothioate
ccugcuuuucggagaguactt

SEQ ID NO: 190 - DNA, 21 bp, Artificial sequence
  Synthetic sequence: human-rhesus ENaC alpha cross-reactive siRNA
  modified_base (2)..(2): um
  modified_base (16)..(16): cm
  misc_feature (20)..(20): t is 2prime - deoxy - thymidine - 5prime - phosphorothioate
guacucuccgaaaagcaggtt

SEQ ID NO: 191 - DNA, 21 bp, Artificial sequence
  Synthetic sequence: human-rhesus ENaC alpha cross-reactive siRNA
  modified_base (2)..(2): cm
  modified_base (3)..(6): um
  modified_base (7)..(7): cm
  modified_base (14)..(14): um
  modified_base (16)..(16): cm
  modified_base (17)..(18): um
  modified_base (19)..(19): cm
  misc_feature (20)..(20): t is 2prime - deoxy - thymidine - 5prime - phosphorothioate
gcuuuucggagaguacuuctt

SEQ ID NO: 192 - DNA, 21 bp, Artificial sequence
  Synthetic sequence: human-rhesus ENaC alpha cross-reactive siRNA
  modified_base (5)..(5): um
  misc_feature (20)..(20): t is 2prime - deoxy - thymidine - 5prime - phosphorothioate
gaaguacucuccgaaaagctt

SEQ ID NO: 193 - DNA, 21 bp, Artificial sequence
  Synthetic sequence: human-rhesus ENaC alpha cross-reactive siRNA
  modified_base (1)..(1): cm
  modified_base (2)..(5): um
  modified_base (6)..(6): cm
  modified_base (13)..(13): um
  modified_base (15)..(15): cm
  modified_base (16)..(17): um
  modified_base (18)..(18): cm
  misc_feature (20)..(20): t is 2prime - deoxy - thymidine - 5prime - phosphorothioate
cuuuucggagaguacuucatt

SEQ ID NO: 194 - DNA, 21 bp, Artificial sequence
  Synthetic sequence: human-rhesus ENaC alpha cross-reactive siRNA
  modified_base (6)..(6): um
  misc_feature (20)..(20): t is 2prime - deoxy - thymidine - 5prime - phosphorothioate
ugaaguacucuccgaaaagtt

SEQ ID NO: 195 - DNA, 21 bp, Artificial sequence
  Synthetic sequence: human-rhesus ENaC alpha cross-reactive siRNA
  modified_base (1)..(1): cm
  modified_base (4)..(5): cm
  modified_base (6)..(6): um
  modified_base (7)..(7): cm
  modified_base (10)..(10): cm
  modified_base (11)..(11): um
  modified_base (12)..(12): cm
  modified_base (16)..(16): cm
  misc_feature (20)..(20): t is 2prime - deoxy - thymidine - 5prime - phosphorothioate
caaccucaacucggacaagtt

SEQ ID NO: 196 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuguccgaguugagguugtt

SEQ ID NO: 197 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(5): cm
  modified_base (9)..(9): cm
  modified_base (11)..(11): um
  modified_base (13)..(13): cm
  modified_base (14)..(14): um
  modified_base (15)..(15): cm
  modified_base (17)..(17): um
  modified_base (18)..(18): cm
  misc_feature (20)..(20): t is 2prime - deoxy - thymidine - 5prime - phosphorothioate
cuaccagacauacucaucatt

SEQ ID NO: 198 - DNA, 21 bp, Artificial sequence
  Synthetic sequence: human-rhesus ENaC alpha cross-reactive siRNA
  modified_base (8)..(8): um
  modified_base (17)..(17): um
  misc_feature (20)..(20): t is 2prime - deoxy - thymidine - 5prime - phosphorothioate
ugaugaguaugucugguagtt

SEQ ID NO: 199 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(4): um
  modified_base (5)..(5): cm
  modified_base (10)..(10): cm
  modified_base (11)..(11): um
  modified_base (13)..(14): cm
  misc_feature (20)..(20): t is 2prime - deoxy - thymidine - 5prime - phosphorothioate
cugucgaggcugccagagatt

SEQ ID NO: 200 - DNA, 21 bp, Artificial sequence
  Synthetic sequence: human-rhesus ENaC alpha cross-reactive siRNA
  modified_base (8)..(8): cm
  modified_base (17)..(17): cm
  misc_feature (20)..(20): t is 2prime - deoxy - thymidine - 5prime - phosphorothioate
ucucuggcagccucgacagtt

SEQ ID NO: 201 - DNA, 21 bp, Artificial sequence
  Synthetic sequence: human-rhesus ENaC alpha cross-reactive siRNA
  modified_base (4)..(4): cm
  modified_base (5)..(5): um
  modified_base (7)..(7): cm
  modified_base (8)..(8): um
  modified_base (10)..(10): um
  modified_base (12)..(12): cm
  modified_base (13)..(15): um
  modified_base (16)..(16): cm
  modified_base (19)..(19): um
  misc_feature (20)..(20): t is 2prime - deoxy - thymidine - 5prime - phosphorothioate
aaacugcuauacuuucaautt

SEQ ID NO: 202 - DNA, 21 bp, Artificial sequence
  Synthetic sequence: human-rhesus ENaC alpha cross-reactive siRNA
  modified_base (9)..(9): um
  modified_base (11)..(11): um
  modified_base (14)..(14): cm
  misc_feature (20)..(20): t is 2prime - deoxy - thymidine - 5prime - phosphorothioate
auugaaaguauagcaguuutt

SEQ ID NO: 203 - DNA, 21 bp, Artificial sequence
  Synthetic sequence: human-rhesus ENaC alpha cross-reactive siRNA
  modified_base (3)..(3): cm
  modified_base (4)..(6): um
  modified_base (9)..(9): cm
  modified_base (10)..(11): um
  modified_base (13)..(13): cm
  modified_base (16)..(17): cm
  modified_base (18)..(18): um
  misc_feature (20)..(20): t is 2prime - deoxy - thymidine - 5prime - phosphorothioate
ggcuuuaacuugcggccugtt

SEQ ID NO: 204 - DNA, 21 bp, Artificial sequence
  Synthetic sequence: human-rhesus ENaC alpha cross-reactive siRNA
  modified_base (1)..(1): cm
  modified_base (8)..(8): cm
  modified_base (13)..(13): um
  misc_feature (20)..(20): t is 2prime - deoxy - thymidine - 5prime - phosphorothioate
caggccgcaaguuaaagcctt

SEQ ID NO: 205 - DNA, 21 bp, Artificial sequence
  Synthetic sequence: human-rhesus ENaC alpha cross-reactive siRNA
  modified_base (1)..(1): cm
  modified_base (2)..(4): um
  modified_base (7)..(7): cm
  modified_base (8)..(9): um
  modified_base (11)..(11): cm
  modified_base (14)..(15): cm
  modified_base (16)..(16): um
  modified_base (19)..(19): cm
  misc_feature (20)..(20): t is 2prime - deoxy - thymidine - 5prime - phosphorothioate
cuuuaacuugcggccuggctt

SEQ ID NO: 206 - DNA, 21 bp, Artificial sequence
  Synthetic sequence: human-rhesus ENaC alpha cross-reactive siRNA
  modified_base (3)..(3): cm
  modified_base (10)..(10): cm
  modified_base (15)..(15): um
  misc_feature (20)..(20): t is 2prime - deoxy - thymidine - 5prime - phosphorothioate
gccaggccgcaaguuaaagtt

SEQ ID NO: 207 - DNA, 21 bp, Artificial sequence
  Synthetic sequence: human-rhesus ENaC alpha cross-reactive siRNA
  modified_base (4)..(4): um
  modified_base (6)..(6): um
  modified_base (8)..(8): um
  modified_base (10)..(11): um
  modified_base (12)..(12): cm
  modified_base (14)..(14): cm
  modified_base (15)..(15): um
  modified_base (16)..(17): cm
  modified_base (18)..(18): um
  misc_feature (20)..(20): t is 2prime - deoxy - thymidine - 5prime - phosphorothioate
agguguguauucacuccugtt

SEQ ID NO: 208 - DNA, 21 bp, Artificial sequence
  Synthetic sequence: human-rhesus ENaC alpha cross-reactive siRNA
  modified_base (1)..(1): cm
  modified_base (11)..(11): um
  modified_base (13)..(13): cm
  modified_base (15)..(15): cm
  misc_feature (20)..(20): t is 2prime - deoxy - thymidine - 5prime - phosphorothioate
caggagugaauacacaccutt

SEQ ID NO: 209 - DNA, 21 bp, Artificial sequence
  Synthetic sequence: human-rhesus ENaC alpha cross-reactive siRNA
  modified_base (2)..(2): cm
  modified_base (5)..(5): um
  modified_base (8)..(10): cm
  modified_base (11)..(11): um
  modified_base (12)..(12): cm
  modified_base (15)..(15): um
  modified_base (18)..(18): cm
  misc_feature (20)..(20): t is 2prime - deoxy - thymidine - 5prime - phosphorothioate
acgauggcccucggugacatt

SEQ ID NO: 210 - DNA, 21 bp, Artificial sequence
  Synthetic sequence: human-rhesus ENaC alpha cross-reactive siRNA
  modified_base (4)..(4): cm
  modified_base (14)..(14): cm
  misc_feature (20)..(20): t is 2prime - deoxy - thymidine - 5prime - phosphorothioate
ugucaccgagggccaucgutt

SEQ ID NO: 211 - DNA, 21 bp, Artificial sequence
  Synthetic sequence: human-rhesus ENaC alpha cross-reactive siRNA
  modified_base (1)..(1): cm
  modified_base (2)..(2): um
  modified_base (6)..(6): cm
  modified_base (8)..(8): cm
  modified_base (9)..(9): um
  modified_base (10)..(10): cm
  modified_base (11)..(11): um
  modified_base (14)..(16): um
  modified_base (17)..(19): cm
  misc_feature (20)..(20): t is 2prime - deoxy - thymidine - 5prime - phosphorothioate
cugaacacucugguuuccctt

SEQ ID NO: 212 - DNA, 21 bp, Artificial sequence
  Synthetic sequence: human-rhesus ENaC alpha cross-reactive siRNA
  modified_base (8)..(8): cm
  modified_base (17)..(17): cm
  misc_feature (20)..(20): t is 2prime - deoxy - thymidine - 5prime - phosphorothioate
gggaaaccagaguguucagtt

SEQ ID NO: 213 - DNA, 21 bp, Artificial sequence
  Synthetic sequence: human-rhesus ENaC alpha cross-reactive siRNA
  modified_base (1)..(1): cm
  modified_base (2)..(2): um
  modified_base (4)..(4): um
  modified_base (7)..(7): cm
  modified_base (9)..(9): um
  modified_base (10)..(10): cm
  modified_base (11)..(11): um
  modified_base (13)..(13): cm
  modified_base (14)..(14): um
  modified_base (19)..(19): um
  misc_feature (20)..(20): t is 2prime - deoxy - thymidine - 5prime - phosphorothioate
cuauaacaucugcuggagutt

SEQ ID NO: 214 - DNA, 21 bp, Artificial sequence
  Synthetic sequence: human-rhesus ENaC alpha cross-reactive siRNA
  modified_base (5)..(5): cm
  modified_base (8)..(8): cm
  modified_base (15)..(15): um
  modified_base (17)..(17): um
  misc_feature (20)..(20): t is 2prime - deoxy - thymidine - 5prime - phosphorothioate
acuccagcagauguuauagtt

SEQ ID NO: 215 - DNA, 21 bp, Artificial sequence
  Synthetic sequence: human-rhesus ENaC alpha cross-reactive siRNA
  modified_base (2)..(2): cm
  modified_base (4)..(5): cm
  modified_base (7)..(7): um
  modified_base (9)..(9): cm
  modified_base (10)..(12): um
  modified_base (13)..(13): cm
  modified_base (14)..(15): um
  modified_base (17)..(17): um
  modified_base (19)..(19): cm
  misc_feature (20)..(20): t is 2prime - deoxy - thymidine - 5prime - phosphorothioate
gcaccauacuuucuuguactt

SEQ ID NO: 216 - DNA, 21 bp, Artificial sequence
  Synthetic sequence: human-rhesus ENaC alpha cross-reactive siRNA
  modified_base (2)..(2): um
  modified_base (4)..(4): cm
  modified_base (12)..(12): um
  misc_feature (20)..(20): t is 2prime - deoxy - thymidine - 5prime - phosphorothioate
guacaagaaaguauggugctt

SEQ ID NO: 217 - DNA, 21 bp, Artificial sequence
  Synthetic sequence: human-rhesus ENaC alpha cross-reactive siRNA
  modified_base (1)..(1): um
  modified_base (3)..(3): um
  modified_base (4)..(4): cm
  modified_base (5)..(5): um
  modified_base (8)..(10): cm
  modified_base (12)..(12): um
  modified_base (13)..(13): cm
  modified_base (15)..(15): um
  modified_base (16)..(17): cm
  modified_base (18)..(18): um
  misc_feature (20)..(20): t is 2prime - deoxy - thymidine - 5prime - phosphorothioate
ugucuagcccaucauccugtt

SEQ ID NO: 218 - DNA, 21 bp, Artificial sequence
  Synthetic sequence: human-rhesus ENaC alpha cross-reactive siRNA
  modified_base (1)..(1): cm
  modified_base (14)..(14): um
  modified_base (18)..(18): cm
  misc_feature (20)..(20): t is 2prime - deoxy - thymidine - 5prime - phosphorothioate
caggaugaugggcuagacatt

SEQ ID NO: 219 - DNA, 21 bp, Artificial sequence
  Synthetic sequence: human-rhesus ENaC alpha cross-reactive siRNA
  modified_base (5)..(7): cm
  modified_base (8)..(8): um
  modified_base (12)..(13): cm
  modified_base (14)..(14): um
  modified_base (15)..(15): cm
  modified_base (16)..(16): um
  modified_base (18)..(18): cm
  misc_feature (20)..(20): t is 2prime - deoxy - thymidine - 5prime - phosphorothioate
aggacccuagaccucugcatt

SEQ ID NO: 220 - DNA, 21 bp, Artificial sequence
  Synthetic sequence: human-rhesus ENaC alpha cross-reactive siRNA
  modified_base (3)..(3): cm
  modified_base (11)..(11): um
  misc_feature (20)..(20): t is 2prime - deoxy - thymidine - 5prime - phosphorothioate
ugcagaggucuaggguccutt

SEQ ID NO: 221 - DNA, 21 bp, Artificial sequence
  Synthetic sequence: human-rhesus ENaC alpha cross-reactive siRNA
  modified_base (1)..(2): cm
  modified_base (4)..(5): cm
  modified_base (7)..(7): cm
  modified_base (8)..(8): um
  modified_base (9)..(10): cm
  modified_base (11)..(11): um
  modified_base (13)..(14): cm
  misc_feature (20)..(20): t is 2prime - deoxy - thymidine - 5prime - phosphorothioate
ccaccgcuccuaccgagagtt

SEQ ID NO: 222 - DNA, 21 bp, Artificial sequence
  Synthetic sequence: human-rhesus ENaC alpha cross-reactive siRNA
  modified_base (8)..(8): um
  misc_feature (20)..(20): t is 2prime - deoxy - thymidine - 5prime - phosphorothioate
cucucgguaggagcgguggtt

SEQ ID NO: 223 - DNA, 21 bp, Artificial sequence
  Synthetic sequence: human-rhesus ENaC alpha cross-reactive siRNA
  modified_base (1)..(1): um
  modified_base (3)..(4): cm
  modified_base (10)..(10): cm
  modified_base (11)..(11): um
  modified_base (12)..(12): cm
  modified_base (13)..(14): um
  modified_base (15)..(15): cm
  modified_base (19)..(19): um
  misc_feature (20)..(20): t is 2prime - deoxy - thymidine - 5prime - phosphorothioate
uaccgagagcucuucgagutt

SEQ ID NO: 224 - DNA, 21 bp, Artificial sequence
  Synthetic sequence: human-rhesus ENaC alpha cross-reactive siRNA
  modified_base (18)..(18): um
  misc_feature (20)..(20): t is 2prime - deoxy - thymidine - 5prime - phosphorothioate
acucgaagagcucucgguatt

SEQ ID NO: 225 - DNA, 21 bp, Artificial sequence
  Synthetic sequence: human-rhesus ENaC alpha cross-reactive siRNA
  modified_base (3)..(3): cm
  modified_base (5)..(5): um
  modified_base (6)..(7): cm
  modified_base (8)..(8): um
  modified_base (10)..(10): um
  modified_base (11)..(11): cm
  modified_base (16)..(16): cm
  modified_base (17)..(17): um
  modified_base (19)..(19): cm
  misc_feature (20)..(20): t is 2prime - deoxy - thymidine - 5prime - phosphorothioate
aacauccugucgaggcugctt

SEQ ID NO: 226 - DNA, 21 bp, Artificial sequence
  Synthetic sequence: human-rhesus ENaC alpha cross-reactive siRNA
  modified_base (2)..(2): cm
  modified_base (11)..(11): cm
  misc_feature (20)..(20): t is 2prime - deoxy - thymidine - 5prime - phosphorothioate
gcagccucgacaggauguutt

SEQ ID NO: 227 - DNA, 21 bp, Artificial sequence
  Synthetic sequence: human-rhesus ENaC alpha cross-reactive siRNA
  modified_base (4)..(5): cm
  modified_base (6)..(8): um
  modified_base (10)..(12): cm
  modified_base (13)..(14): um
  modified_base (15)..(15): cm
  misc_feature (20)..(20): t is 2prime - deoxy - thymidine - 5prime - phosphorothioate
gaaccuuuacccuucaaagtt

SEQ ID NO: 228 - DNA, 21 bp, Artificial sequence
  Synthetic sequence: human-rhesus ENaC alpha cross-reactive siRNA
  modified_base (11)..(11): um
  misc_feature (20)..(20): t is 2prime - deoxy - thymidine - 5prime - phosphorothioate
cuuugaaggguaaagguuctt

SEQ ID NO: 229 - DNA, 21 bp, Artificial sequence
  Synthetic sequence: human-rhesus ENaC alpha cross-reactive siRNA
  modified_base (3)..(4): um
  modified_base (5)..(6): cm
  modified_base (11)..(12): cm
  modified_base (15)..(15): um
  modified_base (17)..(17): cm
  modified_base (18)..(18): um
  misc_feature (20)..(20): t is 2prime - deoxy - thymidine - 5prime - phosphorothioate
gguuccgaagccgauacugtt

SEQ ID NO: 230 - DNA, 21 bp, Artificial sequence
  Synthetic sequence: human-rhesus ENaC alpha cross-reactive siRNA
  modified_base (1)..(1): cm
  modified_base (4)..(4): um
  misc_feature (20)..(20): t is 2prime - deoxy - thymidine - 5prime - phosphorothioate
caguaucggcuucggaacctt

SEQ ID NO: 231 - DNA, 21 bp, Artificial sequence
  Synthetic sequence: human-rhesus ENaC alpha cross-reactive siRNA
  modified_base (4)..(5): cm
  modified_base (8)..(8): um
  modified_base (10)..(10): cm
  modified_base (11)..(11): um
  modified_base (14)..(14): um
  modified_base (15)..(15): cm
  modified_base (16)..(16): um
  modified_base (17)..(18): cm
  misc_feature (20)..(20): t is 2prime - deoxy - thymidine - 5prime - phosphorothioate
aagccgauacuggucuccatt

SEQ ID NO: 232 - DNA, 21 bp, Artificial sequence
  Synthetic sequence: human-rhesus ENaC alpha cross-reactive siRNA
  modified_base (8)..(8): cm
  modified_base (11)..(11): um
  misc_feature (20)..(20): t is 2prime - deoxy - thymidine - 5prime - phosphorothioate
uggagaccaguaucggcuutt

SEQ ID NO: 233 - DNA, 21 bp, Artificial sequence
  Synthetic sequence: human-rhesus ENaC alpha cross-reactive siRNA
  modified_base (1)..(1): um
  modified_base (2)..(2): cm
  modified_base (3)..(3): um
  modified_base (6)..(8): cm
  modified_base (10)..(10): um
  modified_base (11)..(11): cm
  modified_base (13)..(13): um
  modified_base (14)..(15): cm
  modified_base (16)..(16): um
  modified_base (18)..(18): cm
  modified_base (19)..(19): um
  misc_feature (20)..(20): t is 2prime - deoxy - thymidine - 5prime - phosphorothioate
ucuagcccaucauccugcutt

SEQ ID NO: 234 - DNA, 21 bp, Artificial sequence
  Synthetic sequence: human-rhesus ENaC alpha cross-reactive siRNA
  modified_base (3)..(3): cm
  modified_base (16)..(16): um
  misc_feature (20)..(20): t is 2prime - deoxy - thymidine - 5prime - phosphorothioate
agcaggaugaugggcuagatt

SEQ ID NO: 235 - DNA, 21 bp, Artificial sequence
  Synthetic sequence: human-rhesus ENaC alpha cross-reactive siRNA
  modified_base (1)..(1): cm
  modified_base (4)..(4): cm
  modified_base (6)..(7): cm
  modified_base (9)..(9): um
  modified_base (10)..(11): cm
  modified_base (13)..(14): cm
  modified_base (15)..(15): um
  modified_base (18)..(18): um
  misc_feature (20)..(20): t is 2prime - deoxy - thymidine - 5prime - phosphorothioate
cggcgccauccgccuggugtt

SEQ ID NO: 236 - DNA, 21 bp, Artificial sequence
  Synthetic sequence: human-rhesus ENaC alpha cross-reactive siRNA
  modified_base (1)..(1): cm
  modified_base (4)..(4): cm
  misc_feature (20)..(20): t is 2prime - deoxy - thymidine - 5prime - phosphorothioate
caccaggcggauggcgccgtt

SEQ ID NO: 237 - DNA, 21 bp, Artificial sequence
  Synthetic sequence: human-rhesus ENaC alpha cross-reactive siRNA
  modified_base (1)..(4): um
  modified_base (5)..(5): cm
  modified_base (12)..(12): um
  modified_base (14)..(14): cm
  modified_base (15)..(16): um
  modified_base (17)..(17): cm
  misc_feature (20)..(20): t is 2prime - deoxy - thymidine - 5prime - phosphorothioate
uuuucggagaguacuucagtt

SEQ ID NO: 238 - DNA, 21 bp, Artificial sequence
  Synthetic sequence: human-rhesus ENaC alpha cross-reactive siRNA
  modified_base (7)..(7): um
  misc_feature (20)..(20): t is 2prime - deoxy - thymidine - 5prime - phosphorothioate
cugaaguacucuccgaaaatt

SEQ ID NO: 239 - DNA, 21 bp, Artificial sequence
  Synthetic sequence: human-rhesus ENaC alpha cross-reactive siRNA
  modified_base (6)..(6): um
  modified_base (8)..(8): cm
  modified_base (9)..(10): um
  modified_base (11)..(11): cm
  modified_base (14)..(14): cm
  modified_base (15)..(15): um
  modified_base (17)..(19): cm
  misc_feature (20)..(20): t is 2prime - deoxy - thymidine - 5prime - phosphorothioate
gagaguacuucagcuaccctt

SEQ ID NO: 240 - DNA, 21 bp, Artificial sequence
  Synthetic sequence: human-rhesus ENaC alpha cross-reactive siRNA
  modified_base (4)..(4): um
  modified_base (13)..(13): um
  misc_feature (20)..(20): t is 2prime - deoxy - thymidine - 5prime - phosphorothioate
ggguagcugaaguacucuctt

SEQ ID NO: 241 - DNA, 21 bp, Artificial sequence
  Synthetic sequence: human-rhesus ENaC alpha cross-reactive siRNA
  modified_base (3)..(3): cm
  modified_base (5)..(5): cm
  modified_base (6)..(6): um
  modified_base (7)..(7): cm
  modified_base (8)..(10): um
  modified_base (13)..(14): cm
  modified_base (15)..(15): um
  modified_base (17)..(17): um
  modified_base (19)..(19): cm
  misc_feature (20)..(20): t is 2prime - deoxy - thymidine - 5prime - phosphorothioate
gacgcucuuugaccuguactt

SEQ ID NO: 242 - DNA, 21 bp, Artificial sequence
  Synthetic sequence: human-rhesus ENaC alpha cross-reactive siRNA
  modified_base (2)..(2): um
  modified_base (4)..(4): cm
  modified_base (9)..(9): cm
  misc_feature (20)..(20): t is 2prime - deoxy - thymidine - 5prime - phosphorothioate
guacaggucaaagagcguctt

SEQ ID NO: 243 - DNA, 21 bp, Artificial sequence
  Synthetic sequence: human-rhesus ENaC alpha cross-reactive siRNA
  modified_base (1)..(1): um
  modified_base (3)..(3): um
  modified_base (5)..(5): um
  modified_base (7)..(8): um
  modified_base (9)..(9): cm
  modified_base (11)..(11): cm
  modified_base (12)..(12): um
  modified_base (13)..(14): cm
  modified_base (15)..(15): um
  modified_base (17)..(17): cm
  modified_base (18)..(19): um
  misc_feature (20)..(20): t is 2prime - deoxy - thymidine - 5prime - phosphorothioate
uguguauucacuccugcuutt

SEQ ID NO: 244 - DNA, 21 bp, Artificial sequence
  Synthetic sequence: human-rhesus ENaC alpha cross-reactive siRNA
  modified_base (4)..(4): cm
  modified_base (14)..(14): um
  modified_base (16)..(16): cm
  modified_base (18)..(18): cm
  misc_feature (20)..(20): t is 2prime - deoxy - thymidine - 5prime - phosphorothioate
aagcaggagugaauacacatt

SEQ ID NO: 245 - DNA, 21 bp, Artificial sequence
  Synthetic sequence: human-rhesus ENaC alpha cross-reactive siRNA
  modified_base (3)..(3): cm
  modified_base (6)..(6): cm
  modified_base (15)..(15): um
  misc_feature (20)..(20): t is 2prime - deoxy - thymidine - 5prime - phosphorothioate
aacaacaagagaaauggagtt

SEQ ID NO: 246 - DNA, 21 bp, Artificial sequence
  Synthetic sequence: human-rhesus ENaC alpha cross-reactive siRNA
  modified_base (4)..(4): cm
  misc_feature (20)..(20): t is 2prime - deoxy - thymidine - 5prime - phosphorothioate
cuccauuucucuuguuguutt

SEQ ID NO: 247 - DNA, 21 bp, Artificial sequence
  Synthetic sequence: human-rhesus ENaC alpha cross-reactive siRNA
  modified_base (2)..(3): um
  modified_base (10)..(10): um
  modified_base (12)..(12): um
  modified_base (14)..(14): cm
  modified_base (19)..(19): cm
  misc_feature (20)..(20): t is 2prime - deoxy - thymidine - 5prime - phosphorothioate
auugaaggaugugcagggctt

SEQ ID NO: 248 - DNA, 21 bp, Artificial sequence
  Synthetic sequence: human-rhesus ENaC alpha cross-reactive siRNA
  modified_base (7)..(7): cm
  modified_base (9)..(9): cm
  modified_base (16)..(16): cm
  misc_feature (20)..(20): t is 2prime - deoxy - thymidine - 5prime - phosphorothioate
gcccugcacauccuucaautt

SEQ ID NO: 249 - DNA, 21 bp, Artificial sequence
  Synthetic sequence: human-rhesus ENaC alpha cross-reactive siRNA
  modified_base (1)..(1): um
  modified_base (2)..(2): cm
  modified_base (3)..(3): um
  modified_base (4)..(4): cm
  modified_base (9)..(10): cm
  modified_base (12)..(14): cm
  modified_base (18)..(18): cm
  modified_base (19)..(19): um
  misc_feature (20)..(20): t is 2prime - deoxy - thymidine - 5prime - phosphorothioate
ucucagagccgcccaaacutt

SEQ ID NO: 250 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguuugggcggcucugagatt

SEQ ID NO: 251 - DNA, 21 bp, Artificial sequence
  Synthetic sequence: human-rhesus ENaC alpha cross-reactive siRNA
  modified_base (4)..(4): cm
  modified_base (6)..(6): cm
  modified_base (9)..(10): cm
  modified_base (16)..(16): um
  modified_base (18)..(18): cm
  misc_feature (20)..(20): t is 2prime - deoxy - thymidine - 5prime - phosphorothioate
aaacacaaccaaggguacatt

SEQ ID NO: 252 - DNA, 21 bp, Artificial sequence
  Synthetic sequence: human-rhesus ENaC alpha cross-reactive siRNA
  modified_base (3)..(3): um
  misc_feature (20)..(20): t is 2prime - deoxy - thymidine - 5prime - phosphorothioate
uguacccuugguuguguuutt

SEQ ID NO: 253 - DNA, 21 bp, Artificial sequence
  Synthetic sequence: human-rhesus ENaC alpha cross-reactive siRNA
  modified_base (1)..(1): um
  modified_base (3)..(5): cm
  modified_base (7)..(7): um
  modified_base (9)..(11): cm
  modified_base (12)..(12): um
  modified_base (13)..(13): cm
  modified_base (15)..(15): cm
  misc_feature (20)..(20): t is 2prime - deoxy - thymidine - 5prime - phosphorothioate
uacccgugcccucacagagtt

SEQ ID NO: 254 - DNA, 21 bp, Artificial sequence
  Synthetic sequence: human-rhesus ENaC alpha cross-reactive siRNA
  modified_base (12)..(12): cm
  modified_base (18)..(18): um
  misc_feature (20)..(20): t is 2prime - deoxy - thymidine - 5prime - phosphorothioate
cucugugagggcacggguatt

SEQ ID NO: 255 - DNA, 21 bp, Artificial sequence
  Synthetic sequence: human-rhesus ENaC alpha cross-reactive siRNA
  modified_base (1)..(1): um
  modified_base (4)..(4): cm
  modified_base (6)..(6): cm
  modified_base (8)..(8): cm
  modified_base (9)..(9): um
  modified_base (11)..(11): um
  modified_base (14)..(14): cm
  modified_base (16)..(16): um
  modified_base (17)..(17): cm
  modified_base (18)..(18): um
  misc_feature (20)..(20): t is 2prime - deoxy - thymidine - 5prime - phosphorothioate
uagcacacuauaacaucugtt

SEQ ID NO: 256 - DNA, 21 bp, Artificial sequence
  Synthetic sequence: human-rhesus ENaC alpha cross-reactive siRNA
  modified_base (1)..(1): cm
  modified_base (8)..(8): um
  modified_base (10)..(10): um
  modified_base (18)..(18): um
  misc_feature (20)..(20): t is 2prime - deoxy - thymidine - 5prime - phosphorothioate
cagauguuauagugugcuatt

SEQ ID NO: 257 - DNA, 21 bp, Artificial sequence
  Synthetic sequence: human-rhesus ENaC alpha cross-reactive siRNA
  modified_base (3)..(3): um
  modified_base (5)..(5): um
  modified_base (7)..(7): um
  modified_base (9)..(10): um
  modified_base (11)..(11): cm
  modified_base (13)..(13): cm
  modified_base (14)..(14): um
  modified_base (15)..(16): cm
  modified_base (17)..(17): um
  modified_base (19)..(19): cm
  misc_feature (20)..(20): t is 2prime - deoxy - thymidine - 5prime - phosphorothioate
gguguguauucacuccugctt

SEQ ID NO: 258 - DNA, 21 bp, Artificial sequence
  Synthetic sequence: human-rhesus ENaC alpha cross-reactive siRNA
  modified_base (2)..(2): cm
  modified_base (12)..(12): um
  modified_base (14)..(14): cm
  modified_base (16)..(16): cm
  misc_feature (20)..(20): t is 2prime - deoxy - thymidine - 5prime - phosphorothioate
gcaggagugaauacacacctt

SEQ ID NO: 259 - DNA, 21 bp, Artificial sequence
  Synthetic sequence: human-rhesus ENaC alpha cross-reactive siRNA
  modified_base (1)..(1): cm
  modified_base (3)..(3): um
  modified_base (6)..(6): um
  modified_base (7)..(7): cm
  modified_base (14)..(14): um
  modified_base (16)..(16): um
  modified_base (19)..(19): cm
  misc_feature (20)..(20): t is 2prime - deoxy - thymidine - 5prime - phosphorothioate
caugaucaaggaguguggctt

SEQ ID NO: 260 - DNA, 21 bp, Artificial sequence
  Synthetic sequence: human-rhesus ENaC alpha cross-reactive siRNA
  modified_base (3)..(3): cm
  modified_base (5)..(5): cm
  modified_base (16)..(16): cm
  misc_feature (20)..(20): t is 2prime - deoxy - thymidine - 5prime - phosphorothioate
gccacacuccuugaucaugtt

SEQ ID NO: 261 - DNA, 21 bp, Artificial sequence
  Synthetic sequence: human-rhesus ENaC alpha cross-reactive siRNA
  modified_base (2)..(2): cm
  modified_base (3)..(3): um
  modified_base (4)..(4): cm
  modified_base (6)..(6): cm
  modified_base (9)..(9): um
  modified_base (12)..(14): cm
  modified_base (15)..(15): um
  modified_base (16)..(16): cm
  modified_base (19)..(19): um
  misc_feature (20)..(20): t is 2prime - deoxy - thymidine - 5prime - phosphorothioate
acucacgauggcccucggutt

SEQ ID NO: 262 - DNA, 21 bp, Artificial sequence
  Synthetic sequence: human-rhesus ENaC alpha cross-reactive siRNA
  modified_base (10)..(10): cm
  misc_feature (20)..(20): t is 2prime - deoxy - thymidine - 5prime - phosphorothioate
accgagggccaucgugagutt

SEQ ID NO: 263 - DNA, 21 bp, Artificial sequence
  Synthetic sequence: human-rhesus ENaC alpha cross-reactive siRNA
  modified_base (5)..(5): cm
  modified_base (6)..(8): um
  modified_base (11)..(11): cm
  modified_base (18)..(18): cm
  modified_base (19)..(19): um
  misc_feature (20)..(20): t is 2prime - deoxy - thymidine - 5prime - phosphorothioate
ggagcuuugacaaggaacutt

SEQ ID NO: 264 - DNA, 21 bp, Artificial sequence
  Synthetic sequence: human-rhesus ENaC alpha cross-reactive siRNA
  modified_base (11)..(11): cm
  misc_feature (20)..(20): t is 2prime - deoxy - thymidine - 5prime - phosphorothioate
aguuccuugucaaagcucctt

SEQ ID NO: 265 - DNA, 21 bp, Artificial sequence
  Synthetic sequence: human-rhesus ENaC alpha cross-reactive siRNA
  modified_base (2)..(2): um
  modified_base (4)..(6): cm
  modified_base (8)..(8): um
  modified_base (10)..(12): cm
  modified_base (13)..(13): um
  modified_base (14)..(14): cm
  modified_base (16)..(16): cm
  misc_feature (20)..(20): t is 2prime - deoxy - thymidine - 5prime - phosphorothioate
auacccgugcccucacagatt

SEQ ID NO: 266 - DNA, 21 bp, Artificial sequence
  Synthetic sequence: human-rhesus ENaC alpha cross-reactive siRNA
  modified_base (11)..(11): cm
  modified_base (17)..(17): um
  misc_feature (20)..(20): t is 2prime - deoxy - thymidine - 5prime - phosphorothioate
ucugugagggcacggguautt

SEQ ID NO: 267 - DNA, 21 bp, Artificial sequence
  Synthetic sequence: human-rhesus ENaC alpha cross-reactive siRNA
  modified_base (5)..(5): um
  modified_base (8)..(9): cm
  modified_base (14)..(14): um
  modified_base (15)..(15): cm
  modified_base (18)..(18): cm
  misc_feature (20)..(20): t is 2prime - deoxy - thymidine - 5prime - phosphorothioate
ggaguggccaaagucaacatt

SEQ ID NO: 268 - DNA, 21 bp, Artificial sequence
  Synthetic sequence: human-rhesus ENaC alpha cross-reactive siRNA
  modified_base (14)..(14): cm
  misc_feature (20)..(20): t is 2prime - deoxy - thymidine - 5prime - phosphorothioate
uguugacuuuggccacucctt

SEQ ID NO: 269 - DNA, 21 bp, Artificial sequence
  Synthetic sequence: human-rhesus ENaC alpha cross-reactive siRNA
  modified_base (3)..(3): cm
  modified_base (4)..(4): um
  modified_base (6)..(6): cm
  modified_base (11)..(12): cm
  modified_base (15)..(16): um
  modified_base (17)..(17): cm
  modified_base (18)..(18): um
  misc_feature (20)..(20): t is 2prime - deoxy - thymidine - 5prime - phosphorothioate
aacuacaaaaccaauucugtt

SEQ ID NO: 270 - DNA, 21 bp, Artificial sequence
  Synthetic sequence: human-rhesus ENaC alpha cross-reactive siRNA
  modified_base (1)..(1): cm
  modified_base (15)..(15): um
  misc_feature (20)..(20): t is 2prime - deoxy - thymidine - 5prime - phosphorothioate
cagaauugguuuuguaguutt

SEQ ID NO: 271 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (9)..(9): um
  modified_base (11)..(12): um
  modified_base (14)..(14): cm
  modified_base (15)..(15): um
  modified_base (17)..(18): um
  misc_feature (20)..(20): t is 2prime - deoxy - thymidine - 5prime - phosphorothioate
ugcuggaguguugcuguugtt

SEQ ID NO: 272 - DNA, 21 bp, Artificial sequence
  Synthetic sequence: human-rhesus ENaC alpha cross-reactive siRNA
  modified_base (1)..(1): cm
  modified_base (4)..(4): cm
  modified_base (7)..(7): cm
  modified_base (10)..(10): cm
  modified_base (15)..(15): cm
  modified_base (18)..(18): cm
  misc_feature (20)..(20): t is 2prime - deoxy - thymidine - 5prime - phosphorothioate
caacagcaacacuccagcatt

SEQ ID NO: 273 - DNA, 21 bp, Artificial sequence
  Synthetic sequence: human-rhesus ENaC alpha cross-reactive siRNA
  modified_base (4)..(4): um
  modified_base (5)..(5): cm
  modified_base (6)..(6): um
  modified_base (7)..(8): cm
  modified_base (9)..(9): um
  modified_base (11)..(11): cm
  modified_base (14)..(15): cm
  modified_base (19)..(19): cm
  misc_feature (20)..(20): t is 2prime - deoxy - thymidine - 5prime - phosphorothioate
aggucuccugcaaccaggctt

SEQ ID NO: 274 - DNA, 21 bp, Artificial sequence
  Synthetic sequence: human-rhesus ENaC alpha cross-reactive siRNA
  modified_base (10)..(10): cm
  misc_feature (20)..(20): t is 2prime - deoxy - thymidine - 5prime - phosphorothioate
gccugguugcaggagaccutt

SEQ ID NO: 275 - DNA, 21 bp, Artificial sequence
  Synthetic sequence: human-rhesus ENaC alpha cross-reactive siRNA
  modified_base (1)..(1): cm
  modified_base (2)..(4): um
  modified_base (7)..(7): cm
  modified_base (9)..(9): um
  modified_base (12)..(12): um
  modified_base (14)..(14): um
  modified_base (16)..(16): cm
  modified_base (17)..(17): um
  misc_feature (20)..(20): t is 2prime - deoxy - thymidine - 5prime - phosphorothioate
cuuuggcaugauguacuggtt

SEQ ID NO: 276 - DNA, 21 bp, Artificial sequence
  Synthetic sequence: human-rhesus ENaC alpha cross-reactive siRNA
  modified_base (2)..(2): cm
  modified_base (5)..(5): um
  modified_base (7)..(7): cm
  modified_base (10)..(10): cm
  modified_base (15)..(15): cm
  misc_feature (20)..(20): t is 2prime - deoxy - thymidine - 5prime - phosphorothioate
ccaguacaucaugccaaagtt

SEQ ID NO: 277 - DNA, 21 bp, Artificial sequence
  Synthetic sequence: human-rhesus ENaC alpha cross-reactive siRNA
  modified_base (1)..(1): cm
  modified_base (3)..(3): um
  modified_base (4)..(4): cm
  modified_base (5)..(5): um
  modified_base (7)..(7): cm
  modified_base (9)..(11): cm
  modified_base (12)..(12): um
  modified_base (13)..(13): cm
  modified_base (16)..(16): um
  modified_base (17)..(19): cm
  misc_feature (20)..(20): t is 2prime - deoxy - thymidine - 5prime - phosphorothioate
caucugcacccucaauccctt

SEQ ID NO: 278 - DNA, 21 bp, Artificial sequence
  Synthetic sequence: human-rhesus ENaC alpha cross-reactive siRNA
  modified_base (14)..(14): cm
  misc_feature (20)..(20): t is 2prime - deoxy - thymidine - 5prime - phosphorothioate
gggauugagggugcagaugtt

SEQ ID NO: 279 - DNA, 21 bp, Artificial sequence
  Synthetic sequence: human-rhesus ENaC alpha cross-reactive siRNA
  modified_base (1)..(1): cm
  modified_base (4)..(4): cm
  modified_base (5)..(5): um
  modified_base (7)..(7): cm
  modified_base (9)..(10): cm
  modified_base (16)..(16): um
  modified_base (19)..(19): cm
  misc_feature (20)..(20): t is 2prime - deoxy - thymidine - 5prime - phosphorothioate
cgacugcaccaagaauggctt

SEQ ID NO: 280 - DNA, 21 bp, Artificial sequence
  Synthetic sequence: human-rhesus ENaC alpha cross-reactive siRNA
  modified_base (3)..(3): cm
  modified_base (14)..(14): cm
  misc_feature (20)..(20): t is 2prime - deoxy - thymidine - 5prime - phosphorothioate
gccauucuuggugcagucgtt

SEQ ID NO: 281 - DNA, 21 bp, Artificial sequence
  Synthetic sequence: human-rhesus ENaC alpha cross-reactive siRNA
  modified_base (5)..(5): cm
  modified_base (7)..(7): cm
  modified_base (10)..(11): cm
  modified_base (17)..(17): um
  modified_base (19)..(19): cm
  misc_feature (20)..(20): t is 2prime - deoxy - thymidine - 5prime - phosphorothioate
aaaacacaaccaaggguactt

SEQ ID NO: 282 - DNA, 21 bp, Artificial sequence
  Synthetic sequence: human-rhesus ENaC alpha cross-reactive siRNA
  modified_base (2)..(2): um
  misc_feature (20)..(20): t is 2prime - deoxy - thymidine - 5prime - phosphorothioate
guacccuugguuguguuuutt

SEQ ID NO: 283 - DNA, 21 bp, Artificial sequence
  Synthetic sequence: human-rhesus ENaC alpha cross-reactive siRNA
  modified_base (1)..(1): cm
  modified_base (3)..(3): um
  modified_base (4)..(4): cm
  modified_base (5)..(5): um
  modified_base (7)..(7): cm
  modified_base (8)..(8): um
  modified_base (13)..(13): um
  modified_base (15)..(16): um
  modified_base (18)..(18): cm
  modified_base (19)..(19): um
  misc_feature (20)..(20): t is 2prime - deoxy - thymidine - 5prime - phosphorothioate
caucugcuggaguguugcutt

SEQ ID NO: 284 - DNA, 21 bp, Artificial sequence
  Synthetic sequence: human-rhesus ENaC alpha cross-reactive siRNA
  modified_base (3)..(3): cm
  modified_base (6)..(6): cm
  modified_base (11)..(11): cm
  modified_base (14)..(14): cm
  misc_feature (20)..(20): t is 2prime - deoxy - thymidine - 5prime - phosphorothioate
agcaacacuccagcagaugtt

SEQ ID NO: 285 - DNA, 21 bp, Artificial sequence
  Synthetic sequence: human-rhesus ENaC alpha cross-reactive siRNA
  modified_base (1)..(2): cm
  modified_base (3)..(3): um
  modified_base (5)..(5): cm
  modified_base (7)..(7): um
  modified_base (8)..(8): cm
  modified_base (9)..(10): um
  modified_base (11)..(11): cm
  modified_base (12)..(12): um
  modified_base (14)..(14): um
  modified_base (15)..(16): cm
  modified_base (18)..(18): cm
  misc_feature (20)..(20): t is 2prime - deoxy - thymidine - 5prime - phosphorothioate
ccuacaucuucuauccgcgtt

SEQ ID NO: 286 - DNA, 21 bp, Artificial sequence
  Synthetic sequence: human-rhesus ENaC alpha cross-reactive siRNA
  modified_base (7)..(7): um
  modified_base (16)..(16): um
  misc_feature (20)..(20): t is 2prime - deoxy - thymidine - 5prime - phosphorothioate
cgcggauagaagauguaggtt

SEQ ID NO: 287 - DNA, 21 bp, Artificial sequence
  Synthetic sequence: human-rhesus ENaC alpha cross-reactive siRNA
  modified_base (2)..(3): cm
  modified_base (4)..(4): um
  modified_base (6)..(6): cm
  modified_base (8)..(8): um
  modified_base (9)..(9): cm
  modified_base (10)..(11): um
  modified_base (12)..(12): cm
  modified_base (13)..(13): um
  modified_base (15)..(15): um
  modified_base (16)..(17): cm
  modified_base (19)..(19): cm
  misc_feature (20)..(20): t is 2prime - deoxy - thymidine - 5prime - phosphorothioate
gccuacaucuucuauccgctt

SEQ ID NO: 288 - DNA, 21 bp, Artificial sequence
  Synthetic sequence: human-rhesus ENaC alpha cross-reactive siRNA
  modified_base (6)..(6): um
  modified_base (15)..(15): um
  misc_feature (20)..(20): t is 2prime - deoxy - thymidine - 5prime - phosphorothioate
gcggauagaagauguaggctt

SEQ ID NO: 289 - DNA, 21 bp, Artificial sequence
  Synthetic sequence: human-rhesus ENaC alpha cross-reactive siRNA
  modified_base (4)..(4): um
  modified_base (7)..(7): um
  modified_base (9)..(10): cm
  modified_base (12)..(12): cm
  modified_base (13)..(14): um
  modified_base (15)..(16): cm
  modified_base (18)..(18): cm
  modified_base (19)..(19): um
  misc_feature (20)..(20): t is 2prime - deoxy - thymidine - 5prime - phosphorothioate
gagugguaccgcuuccacutt

SEQ ID NO: 290 - DNA, 21 bp, Artificial sequence
  Synthetic sequence: human-rhesus ENaC alpha cross-reactive siRNA
  modified_base (12)..(12): um
  modified_base (15)..(15): cm
  misc_feature (20)..(20): t is 2prime - deoxy - thymidine - 5prime - phosphorothioate
aguggaagcgguaccacuctt

SEQ ID NO: 291 - DNA, 21 bp, Artificial sequence
  Synthetic sequence: human-rhesus ENaC alpha cross-reactive siRNA
  modified_base (3)..(3): um
  modified_base (5)..(6): cm
  modified_base (8)..(8): cm
  modified_base (9)..(10): um
  modified_base (11)..(12): cm
  modified_base (14)..(14): cm
  modified_base (15)..(15): um
  modified_base (17)..(17): cm
  modified_base (19)..(19): um
  misc_feature (20)..(20): t is 2prime - deoxy - thymidine - 5prime - phosphorothioate
gguaccgcuuccacuacautt

SEQ ID NO: 292 - DNA, 21 bp, Artificial sequence
  Synthetic sequence: human-rhesus ENaC alpha cross-reactive siRNA
  modified_base (4)..(4): um
  modified_base (16)..(16): um
  misc_feature (20)..(20): t is 2prime - deoxy - thymidine - 5prime - phosphorothioate
auguaguggaagcgguacctt

SEQ ID NO: 293 - DNA, 21 bp, Artificial sequence
  Synthetic sequence: human-rhesus ENaC alpha cross-reactive siRNA
  modified_base (2)..(2): um
  modified_base (5)..(5): um
  modified_base (7)..(8): cm
  modified_base (10)..(10): cm
  modified_base (11)..(12): um
  modified_base (13)..(14): cm
  modified_base (16)..(16): cm
  modified_base (17)..(17): um
  modified_base (19)..(19): cm
  misc_feature (20)..(20): t is 2prime - deoxy - thymidine - 5prime - phosphorothioate
gugguaccgcuuccacuactt

SEQ ID NO: 294 - DNA, 21 bp, Artificial sequence
  Synthetic sequence: human-rhesus ENaC alpha cross-reactive siRNA
  modified_base (2)..(2): um
  modified_base (14)..(14): um
  modified_base (17)..(17): cm
  misc_feature (20)..(20): t is 2prime - deoxy - thymidine - 5prime - phosphorothioate
guaguggaagcgguaccactt

SEQ ID NO: 295 - DNA, 21 bp, Artificial sequence
  Synthetic sequence: human-rhesus ENaC alpha cross-reactive siRNA
  modified_base (4)..(5): um
  modified_base (7)..(7): cm
  modified_base (8)..(8): um
  modified_base (9)..(9): cm
  modified_base (10)..(10): um
  modified_base (11)..(11): cm
  modified_base (13)..(13): cm
  modified_base (14)..(15): um
  modified_base (16)..(17): cm
  modified_base (19)..(19): cm
  misc_feature (20)..(20): t is 2prime - deoxy - thymidine - 5prime - phosphorothioate
gaauuacucucacuuccactt

SEQ ID NO: 296 - DNA, 21 bp, Artificial sequence
  Synthetic sequence: human-rhesus ENaC alpha cross-reactive siRNA
  modified_base (14)..(14): um
  misc_feature (20)..(20): t is 2prime - deoxy - thymidine - 5prime - phosphorothioate
guggaagugagaguaauuctt

SEQ ID NO: 297 - DNA, 21 bp, Artificial sequence
  Synthetic sequence: human-rhesus ENaC alpha cross-reactive siRNA
  modified_base (3)..(4): um
  modified_base (6)..(6): cm
  modified_base (7)..(7): um
  modified_base (8)..(8): cm
  modified_base (9)..(9): um
  modified_base (10)..(10): cm
  modified_base (12)..(12): cm
  modified_base (13)..(14): um
  modified_base (15)..(16): cm
  modified_base (18)..(19): cm
  misc_feature (20)..(20): t is 2prime - deoxy - thymidine - 5prime - phosphorothioate
aauuacucucacuuccacctt

SEQ ID NO: 298 - DNA, 21 bp, Artificial sequence
  Synthetic sequence: human-rhesus ENaC alpha cross-reactive siRNA
  modified_base (15)..(15): um
  misc_feature (20)..(20): t is 2prime - deoxy - thymidine - 5prime - phosphorothioate
gguggaagugagaguaauutt

SEQ ID NO: 299 - DNA, 21 bp, Artificial sequence
  Synthetic sequence: human-rhesus ENaC alpha cross-reactive siRNA
  modified_base (1)..(1): um
  modified_base (3)..(3): cm
  modified_base (4)..(4): um
  modified_base (5)..(5): cm
  modified_base (6)..(6): um
  modified_base (7)..(7): cm
  modified_base (9)..(9): cm
  modified_base (10)..(11): um
  modified_base (12)..(13): cm
  modified_base (15)..(16): cm
  modified_base (18)..(19): cm
  misc_feature (20)..(20): t is 2prime - deoxy - thymidine - 5prime - phosphorothioate
uacucucacuuccaccacctt

SEQ ID NO: 300 - DNA, 21 bp, Artificial sequence
  Synthetic sequence: human-rhesus ENaC alpha cross-reactive siRNA
  modified_base (18)..(18): um
  misc_feature (20)..(20): t is 2prime - deoxy - thymidine - 5prime - phosphorothioate
ggugguggaagugagaguatt

SEQ ID NO: 301 - DNA, 21 bp, Artificial sequence
  Synthetic sequence: human-rhesus ENaC alpha cross-reactive siRNA
  modified_base (3)..(3): um
  modified_base (6)..(6): um
  modified_base (8)..(9): cm
  modified_base (11)..(11): cm
  modified_base (12)..(13): um
  modified_base (14)..(15): cm
  modified_base (17)..(17): cm
  modified_base (18)..(18): um
  misc_feature (20)..(20): t is 2prime - deoxy - thymidine - 5prime - phosphorothioate
agugguaccgcuuccacuatt

SEQ ID NO: 302 - DNA, 21 bp, Artificial sequence
  Synthetic sequence: human-rhesus ENaC alpha cross-reactive siRNA
  modified_base (1)..(1): um
  modified_base (13)..(13): um
  modified_base (16)..(16): cm
  misc_feature (20)..(20): t is 2prime - deoxy - thymidine - 5prime - phosphorothioate
uaguggaagcgguaccacutt

SEQ ID NO: 303 - DNA, 21 bp, Artificial sequence
  Synthetic sequence: human-rhesus ENaC alpha cross-reactive siRNA
  modified_base (4)..(4): cm
  modified_base (7)..(7): cm
  modified_base (8)..(9): um
  modified_base (10)..(10): cm
  modified_base (12)..(12): um
  modified_base (13)..(13): cm
  modified_base (14)..(15): um
  modified_base (16)..(16): cm
  modified_base (18)..(19): cm
  misc_feature (20)..(20): t is 2prime - deoxy - thymidine - 5prime - phosphorothioate
gggcaacuucaucuucgcctt

SEQ ID NO: 304 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcgaagaugaaguugccctt

SEQ ID NO: 305 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcccguagcguggccucctt

SEQ ID NO: 306 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggaggccacgcuacgggcutt

SEQ ID NO: 307 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccggguaauggugcacgggtt

SEQ ID NO: 308 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cccgugcaccauuacccggtt

SEQ ID NO: 309 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
augcuaucgcgacagaacatt

SEQ ID NO: 310 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uguucugucgcgauagcautt

SEQ ID NO: 311 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcuaucgcgacagaacaatt

SEQ ID NO: 312 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuguucugucgcgauagcatt

SEQ ID NO: 313 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcccguuuauguaugcucctt

SEQ ID NO: 314 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggagcauacauaaacgggctt

SEQ ID NO: 315 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcccguagcguggccuccatt

SEQ ID NO: 316 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uggaggccacgcuacgggctt

SEQ ID NO: 317 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccggaaauuaaagaggagctt

SEQ ID NO: 318 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuccucuuuaauuuccggtt

SEQ ID NO: 319 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgaagguuccgaagccgatt

SEQ ID NO: 320 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucggcuucggaaccuucggtt

SEQ ID NO: 321 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcaauucggccugcuuuuctt

SEQ ID NO: 322 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaaaagcaggccgaauugctt

SEQ ID NO: 323 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcgaauuacucucacuuctt

SEQ ID NO: 324 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaagugagaguaauucgcctt

SEQ ID NO: 325 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcgaauuacucucacuucctt

SEQ ID NO: 326 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggaagugagaguaauucgctt

SEQ ID NO: 327 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaccaggcgaauuacucuctt

SEQ ID NO: 328 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagaguaauucgccugguutt

SEQ ID NO: 329 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguaauggugcacgggcagtt

SEQ ID NO: 330 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugcccgugcaccauuacctt

SEQ ID NO: 331 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cucacgauggcccucggugtt

SEQ ID NO: 332 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caccgagggccaucgugagtt

SEQ ID NO: 333 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuccgaagguuccgaagctt

SEQ ID NO: 334 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuucggaaccuucggagctt

SEQ ID NO: 335 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccgauacuggucuccaggtt

SEQ ID NO: 336 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccuggagaccaguaucggctt

SEQ ID NO: 337 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgauacuggucuccaggctt

SEQ ID NO: 338 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccuggagaccaguaucggtt

SEQ ID NO: 339 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcuguugcaccauacuuutt

SEQ ID NO: 340 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaaguauggugcaacagcatt

SEQ ID NO: 341 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aacggucugucccugaugctt

SEQ ID NO: 342 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcaucagggacagaccguutt

SEQ ID NO: 343 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuaacuugcggccuggcgutt

SEQ ID NO: 344 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acgccaggccgcaaguuaatt

SEQ ID NO: 345 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcugguuacucacgauggctt

SEQ ID NO: 346 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccaucgugaguaaccagctt

SEQ ID NO: 347 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuacucacgauggcccucgtt

SEQ ID NO: 348 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cgagggccaucgugaguaatt

SEQ ID NO: 349 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaagccgauacuggucucctt

SEQ ID NO: 350 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggagaccaguaucggcuuctt

SEQ ID NO: 351 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gauacuggucuccaggccgtt

SEQ ID NO: 352 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cggccuggagaccaguauctt

SEQ ID NO: 353 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
auacuggucuccaggccgatt

SEQ ID NO: 354 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucggccuggagaccaguautt

SEQ ID NO: 355 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caacggucugucccugaugtt

SEQ ID NO: 356 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caucagggacagaccguugtt

SEQ ID NO: 357 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuuaacuugcggccuggcgtt

SEQ ID NO: 358 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cgccaggccgcaaguuaaatt

SEQ ID NO: 359 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacucacgauggcccucggtt

SEQ ID NO: 360 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgagggccaucgugaguatt

SEQ ID NO: 361 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuucggagaguacuucagctt

SEQ ID NO: 362 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcugaaguacucuccgaaatt

SEQ ID NO: 363 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcagacgcucuuugaccugtt

SEQ ID NO: 364 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caggucaaagagcgucugctt

SEQ ID NO: 365 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuacaucuucuauccgcggtt

SEQ ID NO: 366 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgcggauagaagauguagtt

SEQ ID NO: 367 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggcgaauuacucucacuutt

SEQ ID NO: 368 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aagugagaguaauucgccutt

SEQ ID NO: 369 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgcuucaaccaggucucctt

SEQ ID NO: 370 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggagaccugguugaagcggtt

SEQ ID NO: 371 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caaccgcaugaagacggcctt

SEQ ID NO: 372 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggccgucuucaugcgguugtt

SEQ ID NO: 373 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
augaagacggccuucugggtt

SEQ ID NO: 374 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cccagaaggccgucuucautt

SEQ ID NO: 375 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcacaaccgcaugaagactt

SEQ ID NO: 376 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gucuucaugcgguugugcutt

SEQ ID NO: 377 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucgaguuccaccgcuccuatt

SEQ ID NO: 378 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaggagcgguggaacucgatt

SEQ ID NO: 379 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugcuucuaccagacauactt

SEQ ID NO: 380 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guaugucugguagaagcagtt

SEQ ID NO: 381 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagggagugguaccgcuuctt

SEQ ID NO: 382 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaagcgguaccacucccuctt

SEQ ID NO: 383 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccuuuauggaugaugguggtt

SEQ ID NO: 384 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccaccaucauccauaaaggtt

SEQ ID NO: 385 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugagggagugguaccgcuutt

SEQ ID NO: 386 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aagcgguaccacucccucatt

SEQ ID NO: 387 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccugcaaccaggcgaauuatt

SEQ ID NO: 388 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaauucgccugguugcaggtt

SEQ ID NO: 389 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggccuggcguggagaccuctt

SEQ ID NO: 390 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaggucuccacgccaggcctt

SEQ ID NO: 391 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcuuuucggagaguacuutt

SEQ ID NO: 392 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaguacucuccgaaaagcatt

SEQ ID NO: 393 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cccguagcguggccuccagtt

SEQ ID NO: 394 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuggaggccacgcuacgggtt

SEQ ID NO: 395 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccguagcguggccuccagctt

SEQ ID NO: 396 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuggaggccacgcuacggtt

SEQ ID NO: 397 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccaggcgaauuacucucactt

SEQ ID NO: 398 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gugagaguaauucgccuggtt

SEQ ID NO: 399 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaaacugcuauacuuucaatt

SEQ ID NO: 400 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uugaaaguauagcaguuuctt

SEQ ID NO: 401 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcccggguaauggugcacgtt

SEQ ID NO: 402 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cgugcaccauuacccgggctt

SEQ ID NO: 403 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cccggguaauggugcacggtt

SEQ ID NO: 404 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgugcaccauuacccgggtt

SEQ ID NO: 405 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cggguaauggugcacgggctt

SEQ ID NO: 406 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcccgugcaccauuacccgtt

SEQ ID NO: 407 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggguaauggugcacgggcatt

SEQ ID NO: 408 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcccgugcaccauuaccctt

SEQ ID NO: 409 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaauggugcacgggcaggatt

SEQ ID NO: 410 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uccugcccgugcaccauuatt

SEQ ID NO: 411 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugguuacucacgauggcctt

SEQ ID NO: 412 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggccaucgugaguaaccagtt

SEQ ID NO: 413 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guuacucacgauggcccuctt

SEQ ID NO: 414 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagggccaucgugaguaactt

SEQ ID NO: 415 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugucacgauggucacccuctt

SEQ ID NO: 416 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagggugaccaucgugacatt

SEQ ID NO: 417 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcuccgaagguuccgaagtt

SEQ ID NO: 418 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuucggaaccuucggagcatt

SEQ ID NO: 419 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uccgaagguuccgaagccgtt

SEQ ID NO: 420 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cggcuucggaaccuucggatt

SEQ ID NO: 421 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuccgaagccgauacuggutt

SEQ ID NO: 422 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
accaguaucggcuucggaatt

SEQ ID NO: 423 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agccgauacuggucuccagtt

SEQ ID NO: 424 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuggagaccaguaucggcutt

SEQ ID NO: 425 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuugguacugccucugaactt

SEQ ID NO: 426 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guucagaggcaguaccaagtt

SEQ ID NO: 427 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cucccguagcacacuauaatt

SEQ ID NO: 428 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuauagugugcuacgggagtt

SEQ ID NO: 429 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucccguagcacacuauaactt

SEQ ID NO: 430 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guuauagugugcuacgggatt

SEQ ID NO: 431 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcaccauacuuucuuguatt

SEQ ID NO: 432 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacaagaaaguauggugcatt

SEQ ID NO: 433 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uugcccguuuauguaugcutt

SEQ ID NO: 434 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcauacauaaacgggcaatt

SEQ ID NO: 435 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcccguuuauguaugcuctt

SEQ ID NO: 436 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagcauacauaaacgggcatt

SEQ ID NO: 437 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggacccuagaccucugcagtt

SEQ ID NO: 438 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugcagaggucuagggucctt

SEQ ID NO: 439 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccuagaccucugcagcccatt

SEQ ID NO: 440 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugggcugcagaggucuaggtt

SEQ ID NO: 441 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uggcaugauguacuggcaatt

SEQ ID NO: 442 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uugccaguacaucaugccatt

SEQ ID NO: 443 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacuggcaauucggccugctt

SEQ ID NO: 444 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcaggccgaauugccaguatt

SEQ ID NO: 445 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aauucggccugcuuuucggtt

SEQ ID NO: 446 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccgaaaagcaggccgaauutt

SEQ ID NO: 447 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugcuuuucggagaguacutt

SEQ ID NO: 448 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguacucuccgaaaagcagtt

SEQ ID NO: 449 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uucggagaguacuucagcutt

SEQ ID NO: 450 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcugaaguacucuccgaatt

SEQ ID NO: 451 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcagacgcucuuugaccutt

SEQ ID NO: 452 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggucaaagagcgucugcutt

SEQ ID NO: 453 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuugcagcgccugaggguctt

SEQ ID NO: 454 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gacccucaggcgcugcaagtt

SEQ ID NO: 455 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uggcuuuaacuugcggccutt

SEQ ID NO: 456 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggccgcaaguuaaagccatt

SEQ ID NO: 457 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuuuaacuugcggccuggtt

SEQ ID NO: 458 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccaggccgcaaguuaaagctt

SEQ ID NO: 459 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaacuugcggccuggcgugtt

SEQ ID NO: 460 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cacgccaggccgcaaguuatt

SEQ ID NO: 461 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
accuuuacccuucaaaguatt

SEQ ID NO: 462 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacuuugaaggguaaaggutt

SEQ ID NO: 463 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguuacucacgauggcccutt

SEQ ID NO: 464 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agggccaucgugaguaacctt

SEQ ID NO: 465 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cacgauggcccucggugactt

SEQ ID NO: 466 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gucaccgagggccaucgugtt

SEQ ID NO: 467 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agaugcuaucgcgacagaatt

SEQ ID NO: 468 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uucugucgcgauagcaucutt

SEQ ID NO: 469 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acgauggucacccuccugutt

SEQ ID NO: 470 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acaggagggugaccaucgutt

SEQ ID NO: 471 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuccgaagguuccgaagcctt

SEQ ID NO: 472 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcuucggaaccuucggagtt

SEQ ID NO: 473 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aagguuccgaagccgauactt

SEQ ID NO: 474 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guaucggcuucggaaccuutt

SEQ ID NO: 475 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguacugccucugaacacutt

SEQ ID NO: 476 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguguucagaggcaguacctt

SEQ ID NO: 477 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcuuugacaaggaacuuutt

SEQ ID NO: 478 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaaguuccuugucaaagcutt

SEQ ID NO: 479 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuugacaaggaacuuuccutt

SEQ ID NO: 480 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggaaaguuccuugucaaatt

SEQ ID NO: 481 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugacaaggaacuuuccuaatt

SEQ ID NO: 482 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuaggaaaguuccuugucatt

SEQ ID NO: 483 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cccguagcacacuauaacatt

SEQ ID NO: 484 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uguuauagugugcuacgggtt

SEQ ID NO: 485 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cacuauaacaucugcuggatt

SEQ ID NO: 486 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uccagcagauguuauagugtt

SEQ ID NO: 487 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uugcuguugcaccauacuutt

SEQ ID NO: 488 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaguauggugcaacagcaatt

SEQ ID NO: 489 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guacuggcaauucggccugtt

SEQ ID NO: 490 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caggccgaauugccaguactt

SEQ ID NO: 491 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uucggccugcuuuucggagtt

SEQ ID NO: 492 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuccgaaaagcaggccgaatt

SEQ ID NO: 493 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccugcuuuucggagaguactt

SEQ ID NO: 494 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guacucuccgaaaagcaggtt

SEQ ID NO: 495 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcuuuucggagaguacuuctt

SEQ ID NO: 496 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaaguacucuccgaaaagctt

SEQ ID NO: 497 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuuucggagaguacuucatt

SEQ ID NO: 498 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugaaguacucuccgaaaagtt

SEQ ID NO: 499 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caaccucaacucggacaagtt

SEQ ID NO: 500 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuguccgaguugagguugtt

SEQ ID NO: 501 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuaccagacauacucaucatt

SEQ ID NO: 502 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugaugaguaugucugguagtt

SEQ ID NO: 503 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugucgaggcugccagagatt

SEQ ID NO: 504 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucucuggcagccucgacagtt

SEQ ID NO: 505 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaacugcuauacuuucaautt

SEQ ID NO: 506 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
auugaaaguauagcaguuutt

SEQ ID NO: 507 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcuuuaacuugcggccugtt

SEQ ID NO: 508 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caggccgcaaguuaaagcctt

SEQ ID NO: 509 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuuaacuugcggccuggctt

SEQ ID NO: 510 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccaggccgcaaguuaaagtt

SEQ ID NO: 511 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agguguguauucacuccugtt

SEQ ID NO: 512 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caggagugaauacacaccutt

SEQ ID NO: 513 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acgauggcccucggugacatt

SEQ ID NO: 514 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugucaccgagggccaucgutt

SEQ ID NO: 515 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugaacacucugguuuccctt

SEQ ID NO: 516 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gggaaaccagaguguucagtt

SEQ ID NO: 517 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuauaacaucugcuggagutt

SEQ ID NO: 518 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acuccagcagauguuauagtt

SEQ ID NO: 519 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcaccauacuuucuuguactt

SEQ ID NO: 520 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guacaagaaaguauggugctt

SEQ ID NO: 521 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugucuagcccaucauccugtt

SEQ ID NO: 522 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caggaugaugggcuagacatt

SEQ ID NO: 523 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggacccuagaccucugcatt

SEQ ID NO: 524 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcagaggucuaggguccutt

SEQ ID NO: 525 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccaccgcuccuaccgagagtt

SEQ ID NO: 526 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cucucgguaggagcgguggtt

SEQ ID NO: 527 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaccgagagcucuucgagutt

SEQ ID NO: 528 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acucgaagagcucucgguatt

SEQ ID NO: 529 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aacauccugucgaggcugctt

SEQ ID NO: 530 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcagccucgacaggauguutt

SEQ ID NO: 531 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaaccuuuacccuucaaagtt

SEQ ID NO: 532 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuugaaggguaaagguuctt

SEQ ID NO: 533 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguuccgaagccgauacugtt

SEQ ID NO: 534 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caguaucggcuucggaacctt

SEQ ID NO: 535 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aagccgauacuggucuccatt

SEQ ID NO: 536 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uggagaccaguaucggcuutt

SEQ ID NO: 537 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucuagcccaucauccugcutt

SEQ ID NO: 538 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcaggaugaugggcuagatt

SEQ ID NO: 539 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cggcgccauccgccuggugtt

SEQ ID NO: 540 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caccaggcggauggcgccgtt

SEQ ID NO: 541 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uuuucggagaguacuucagtt

SEQ ID NO: 542 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cugaaguacucuccgaaaatt

SEQ ID NO: 543 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagaguacuucagcuaccctt

SEQ ID NO: 544 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggguagcugaaguacucuctt

SEQ ID NO: 545 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gacgcucuuugaccuguactt

SEQ ID NO: 546 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guacaggucaaagagcguctt

SEQ ID NO: 547 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uguguauucacuccugcuutt

SEQ ID NO: 548 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aagcaggagugaauacacatt

SEQ ID NO: 549 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aacaacaagagaaauggagtt

SEQ ID NO: 550 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuccauuucucuuguuguutt

SEQ ID NO: 551 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
auugaaggaugugcagggctt

SEQ ID NO: 552 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcccugcacauccuucaautt

SEQ ID NO: 553 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucucagagccgcccaaacutt

SEQ ID NO: 554 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguuugggcggcucugagatt

SEQ ID NO: 555 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaacacaaccaaggguacatt

SEQ ID NO: 556 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uguacccuugguuguguuutt

SEQ ID NO: 557 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacccgugcccucacagagtt

SEQ ID NO: 558 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cucugugagggcacggguatt

SEQ ID NO: 559 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uagcacacuauaacaucugtt

SEQ ID NO: 560 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cagauguuauagugugcuatt

SEQ ID NO: 561 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguguguauucacuccugctt

SEQ ID NO: 562 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcaggagugaauacacacctt

SEQ ID NO: 563 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caugaucaaggaguguggctt

SEQ ID NO: 564 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccacacuccuugaucaugtt

SEQ ID NO: 565 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
acucacgauggcccucggutt

SEQ ID NO: 566 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
accgagggccaucgugagutt

SEQ ID NO: 567 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggagcuuugacaaggaacutt

SEQ ID NO: 568 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguuccuugucaaagcucctt

SEQ ID NO: 569 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
auacccgugcccucacagatt

SEQ ID NO: 570 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ucugugagggcacggguautt

SEQ ID NO: 571 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggaguggccaaagucaacatt

SEQ ID NO: 572 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uguugacuuuggccacucctt

SEQ ID NO: 573 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aacuacaaaaccaauucugtt

SEQ ID NO: 574 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cagaauugguuuuguaguutt

SEQ ID NO: 575 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ugcuggaguguugcuguugtt

SEQ ID NO: 576 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caacagcaacacuccagcatt

SEQ ID NO: 577 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aggucuccugcaaccaggctt

SEQ ID NO: 578 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccugguugcaggagaccutt

SEQ ID NO: 579 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cuuuggcaugauguacuggtt

SEQ ID NO: 580 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccaguacaucaugccaaagtt

SEQ ID NO: 581 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caucugcacccucaauccctt

SEQ ID NO: 582 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gggauugagggugcagaugtt

SEQ ID NO: 583 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cgacugcaccaagaauggctt

SEQ ID NO: 584 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccauucuuggugcagucgtt

SEQ ID NO: 585 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aaaacacaaccaaggguactt

SEQ ID NO: 586 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guacccuugguuguguuuutt

SEQ ID NO: 587 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
caucugcuggaguguugcutt

SEQ ID NO: 588 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agcaacacuccagcagaugtt

SEQ ID NO: 589 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ccuacaucuucuauccgcgtt

SEQ ID NO: 590 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
cgcggauagaagauguaggtt

SEQ ID NO: 591 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gccuacaucuucuauccgctt

SEQ ID NO: 592 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gcggauagaagauguaggctt

SEQ ID NO: 593 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gagugguaccgcuuccacutt

SEQ ID NO: 594 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aguggaagcgguaccacuctt

SEQ ID NO: 595 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguaccgcuuccacuacautt

SEQ ID NO: 596 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
auguaguggaagcgguacctt

SEQ ID NO: 597 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gugguaccgcuuccacuactt

SEQ ID NO: 598 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guaguggaagcgguaccactt

SEQ ID NO: 599 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gaauuacucucacuuccactt

SEQ ID NO: 600 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
guggaagugagaguaauuctt

SEQ ID NO: 601 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
aauuacucucacuuccacctt

SEQ ID NO: 602 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gguggaagugagaguaauutt

SEQ ID NO: 603 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uacucucacuuccaccacctt

SEQ ID NO: 604 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggugguggaagugagaguatt

SEQ ID NO: 605 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
agugguaccgcuuccacuatt

SEQ ID NO: 606 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
uaguggaagcgguaccacutt

SEQ ID NO: 607 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
gggcaacuucaucuucgcctt

SEQ ID NO: 608 - DNA, 21 bp, Artificial sequence
  Synthetic sequence: human-rhesus ENaC alpha cross-reactive siRNA
  misc_feature (20)..(20): t is 2prime - deoxy - thymidine - 5prime - phosphorothioate
ggcgaagaugaaguugccctt

SEQ ID NO: 609 - DNA, 21 bp, Artificial sequence
  Synthetic sequence: "human only" siRNA
  misc_feature (20)..(20): t is 2prime - deoxy - thymidine - 5prime - phosphorothioate
cugcggcuaagucucuuuutt

SEQ ID NO: 610 - DNA, 21 bp, Artificial sequence
  Synthetic sequence: "human only" siRNA
  misc_feature (20)..(20): t is 2prime - deoxy - thymidine - 5prime - phosphorothioate
aaaagagacuuagccgcagtt

SEQ ID NO: 611 - DNA, 21 bp, Artificial sequence
  Synthetic sequence: "human only" siRNA
  misc_feature (20)..(20): t is 2prime - deoxy - thymidine - 5prime - phosphorothioate
aucgcgacagaacaauuactt

SEQ ID NO: 612 - DNA, 21 bp, Artificial sequence
  Synthetic sequence: "human only" siRNA
  misc_feature (20)..(20): t is 2prime - deoxy - thymidine - 5prime - phosphorothioate
guaauuguucugucgcgautt

SEQ ID NO: 613 - DNA, 21 bp, Artificial sequence
  Synthetic sequence: "human only" siRNA
  misc_feature (20)..(20): t is 2prime - deoxy - thymidine - 5prime - phosphorothioate
ucgcgacagaacaauuacatt

SEQ ID NO: 614 - DNA, 21 bp, Artificial sequence
  Synthetic sequence: "human only" siRNA
  misc_feature (20)..(20): t is 2prime - deoxy - thymidine - 5prime - phosphorothioate
uguaauuguucugucgcgatt

SEQ ID NO: 615 - DNA, 21 bp, Artificial sequence
  Synthetic sequence: "human only" siRNA
  misc_feature (20)..(20): t is 2prime - deoxy - thymidine - 5prime - phosphorothioate
cccguuuauguaugcuccatt

SEQ ID NO: 616 - DNA, 21 bp, Artificial sequence
  Synthetic sequence: "human only" siRNA
  misc_feature (20)..(20): t is 2prime - deoxy - thymidine - 5prime - phosphorothioate
uggagcauacauaaacgggtt

SEQ ID NO: 617 - DNA, 21 bp, Artificial sequence
  Synthetic sequence: "human only" siRNA
  misc_feature (20)..(20): t is 2prime - deoxy - thymidine - 5prime - phosphorothioate
cccggguaaguaaaggcagtt

SEQ ID NO: 618 - DNA, 21 bp, Artificial sequence
  Synthetic sequence: "human only" siRNA
  misc_feature (20)..(20): t is 2prime - deoxy - thymidine - 5prime - phosphorothioate
cugccuuuacuuacccgggtt

SEQ ID NO: 619 - DNA, 21 bp, Artificial sequence
  Synthetic sequence: "human only" siRNA
  misc_feature (20)..(20): t is 2prime - deoxy - thymidine - 5prime - phosphorothioate
gguacccggaaauuaaagatt

SEQ ID NO: 620 - DNA, 21 bp, Artificial sequence
  Synthetic sequence: "human only" siRNA
  misc_feature (20)..(20): t is 2prime - deoxy - thymidine - 5prime - phosphorothioate
ucuuuaauuuccggguacctt

SEQ ID NO: 621 - DNA, 21 bp, Artificial sequence
  Synthetic sequence: "human only" siRNA
  misc_feature (20)..(20): t is 2prime - deoxy - thymidine - 5prime - phosphorothioate
gcuaucgcgacagaacaautt

SEQ ID NO: 622 - DNA, 21 bp, Artificial sequence
  Synthetic sequence: "human only" siRNA
  misc_feature (20)..(20): t is 2prime - deoxy - thymidine - 5prime - phosphorothioate
auuguucugucgcgauagctt

SEQ ID NO: 623 - DNA, 21 bp, Artificial sequence
  Synthetic sequence: "human only" siRNA
  misc_feature (20)..(20): t is 2prime - deoxy - thymidine - 5prime - phosphorothioate
uaucgcgacagaacaauuatt

SEQ ID NO: 624 - DNA, 21 bp, Artificial sequence
  Synthetic sequence: "human only" siRNA
  misc_feature (20)..(20): t is 2prime - deoxy - thymidine - 5prime - phosphorothioate
uaauuguucugucgcgauatt

SEQ ID NO: 625 - DNA, 21 bp, Artificial sequence
  Synthetic sequence: "human only" siRNA
  misc_feature (20)..(20): t is 2prime - deoxy - thymidine - 5prime - phosphorothioate
ugcggcuaagucucuuuuutt

SEQ ID NO: 626 - DNA, 21 bp, Artificial sequence
  Synthetic sequence: "human only" siRNA
  misc_feature (20)..(20): t is 2prime - deoxy - thymidine - 5prime - phosphorothioate
aaaaagagacuuagccgcatt

SEQ ID NO: 627 - DNA, 21 bp, Artificial sequence
  Synthetic sequence: "human only" siRNA
  misc_feature (20)..(20): t is 2prime - deoxy - thymidine - 5prime - phosphorothioate
ggcgauuauggcgacugcatt

SEQ ID NO: 628 - DNA, 21 bp, Artificial sequence
  Synthetic sequence: "human only" siRNA
  misc_feature (20)..(20): t is 2prime - deoxy - thymidine - 5prime - phosphorothioate
ugcagucgccauaaucgcctt

SEQ ID NO: 629 - DNA, 21 bp, Artificial sequence
  Synthetic sequence: "human only" siRNA
  misc_feature (20)..(20): t is 2prime - deoxy - thymidine - 5prime - phosphorothioate
augucuagcccaucauccutt

SEQ ID NO: 630 - DNA, 21 bp, Artificial sequence
  Synthetic sequence: "human only" siRNA
  misc_feature (20)..(20): t is 2prime - deoxy - thymidine - 5prime - phosphorothioate
aggaugaugggcuagacautt

SEQ ID NO: 631 - DNA, 21 bp, Artificial sequence
  Synthetic sequence: "human only" siRNA
  misc_feature (20)..(20): t is 2prime - deoxy - thymidine - 5prime - phosphorothioate
cuacagguacccggaaauutt

SEQ ID NO: 632 - DNA, 21 bp, Artificial sequence
  Synthetic sequence: "human only" siRNA
  misc_feature (20)..(20): t is 2prime - deoxy - thymidine - 5prime - phosphorothioate
aauuuccggguaccuguagtt

SEQ ID NO: 633 - DNA, 21 bp, Artificial sequence
  Synthetic sequence: "human only" siRNA
  misc_feature (20)..(20): t is 2prime - deoxy - thymidine - 5prime - phosphorothioate
ccgucgagcccguagcgugtt

SEQ ID NO: 634 - DNA, 21 bp, Artificial sequence
  Synthetic sequence: "human only" siRNA
  misc_feature (20)..(20): t is 2prime - deoxy - thymidine - 5prime - phosphorothioate
cacgcuacgggcucgacggtt

SEQ ID NO: 635 - DNA, 21 bp, Artificial sequence
  Synthetic sequence: "human only" siRNA
  misc_feature (20)..(20): t is 2prime - deoxy - thymidine - 5prime - phosphorothioate
cgcgacagaacaauuacactt

SEQ ID NO: 636 - DNA, 21 bp, Artificial sequence
  Synthetic sequence: "human only" siRNA
  misc_feature (20)..(20): t is 2prime - deoxy - thymidine - 5prime - phosphorothioate
guguaauuguucugucgcgtt

SEQ ID NO: 637 - DNA, 21 bp, Artificial sequence
  Synthetic sequence: "human only" siRNA
  misc_feature (20)..(20): t is 2prime - deoxy - thymidine - 5prime - phosphorothioate
agguacccggaaauuaaagtt

SEQ ID NO: 638 - DNA, 21 bp, Artificial sequence
  Synthetic sequence: "human only" siRNA
  misc_feature (20)..(20): t is 2prime - deoxy - thymidine - 5prime - phosphorothioate
cuuuaauuuccggguaccutt

SEQ ID NO: 639 - DNA, 21 bp, Artificial sequence
  Synthetic sequence: "human only" siRNA
  misc_feature (20)..(20): t is 2prime - deoxy - thymidine - 5prime - phosphorothioate
caugcacggguuuccugcctt

SEQ ID NO: 640 - DNA, 21 bp, Artificial sequence
  Synthetic sequence: "human only" siRNA
  misc_feature (20)..(20): t is 2prime - deoxy - thymidine - 5prime - phosphorothioate
ggcaggaaacccgugcaugtt

SEQ ID NO: 641 - DNA, 21 bp, Artificial sequence
  Synthetic sequence: "human only" siRNA
  misc_feature (20)..(20): t is 2prime - deoxy - thymidine - 5prime - phosphorothioate
agcuugcgggacaacaacctt

SEQ ID NO: 642 - DNA, 21 bp, Artificial sequence
  Synthetic sequence: "human only" siRNA
  misc_feature (20)..(20): t is 2prime - deoxy - thymidine - 5prime - phosphorothioate
gguuguugucccgcaagcutt

SEQ ID NO: 643 - DNA, 21 bp, Artificial sequence
  Synthetic sequence: "human only" siRNA
  misc_feature (20)..(20): t is 2prime - deoxy - thymidine - 5prime - phosphorothioate
acugcggcuaagucucuuutt

SEQ ID NO: 644 - DNA, 21 bp, Artificial sequence
  Synthetic sequence: "human only" siRNA
  misc_feature (20)..(20): t is 2prime - deoxy - thymidine - 5prime - phosphorothioate
aaagagacuuagccgcagutt

SEQ ID NO: 645 - DNA, 21 bp, Artificial sequence
  Synthetic sequence: "human only" siRNA
  misc_feature (20)..(20): t is 2prime - deoxy - thymidine - 5prime - phosphorothioate
caucccuuagaacccugcutt

SEQ ID NO: 646 - DNA, 21 bp, Artificial sequence
  Synthetic sequence: "human only" siRNA
  misc_feature (20)..(20): t is 2prime - deoxy - thymidine - 5prime - phosphorothioate
agcaggguucuaagggaugtt

SEQ ID NO: 647 - DNA, 21 bp, Artificial sequence
  Synthetic sequence: "human only" siRNA
  misc_feature (20)..(20): t is 2prime - deoxy - thymidine - 5prime - phosphorothioate
acccggguaaguaaaggcatt

SEQ ID NO: 648 - DNA, 21 bp, Artificial sequence
  Synthetic sequence: "human only" siRNA
  misc_feature (20)..(20): t is 2prime - deoxy - thymidine - 5prime - phosphorothioate
ugccuuuacuuacccgggutt

SEQ ID NO: 649 - DNA, 21 bp, Artificial sequence
  Synthetic sequence: "human only" siRNA
  misc_feature (20)..(20): t is 2prime - deoxy - thymidine - 5prime - phosphorothioate
gauuauggcgacugcaccatt

SEQ ID NO: 650 - DNA, 21 bp, Artificial sequence
  Synthetic sequence: "human only" siRNA
  misc_feature (20)..(20): t is 2prime - deoxy - thymidine - 5prime - phosphorothioate
uggugcagucgccauaauctt

SEQ ID NO: 651 - DNA, 21 bp, Artificial sequence
  Synthetic sequence: "human only" siRNA
  misc_feature (20)..(20): t is 2prime - deoxy - thymidine - 5prime - phosphorothioate
cucggacaagcucgucuuctt

SEQ ID NO: 652 - DNA, 21 bp, Artificial sequence
  Synthetic sequence: "human only" siRNA
  misc_feature (20)..(20): t is 2prime - deoxy - thymidine - 5prime - phosphorothioate
gaagacgagcuuguccgagtt

SEQ ID NO: 653 - DNA, 21 bp, Artificial sequence
  Synthetic sequence: "human only" siRNA
  misc_feature (20)..(20): t is 2prime - deoxy - thymidine - 5prime - phosphorothioate
gcgauuauggcgacugcactt

SEQ ID NO: 654 - DNA, 21 bp, Artificial sequence
  Synthetic sequence: "human only" siRNA
  misc_feature (20)..(20): t is 2prime - deoxy - thymidine - 5prime - phosphorothioate
gugcagucgccauaaucgctt

SEQ ID NO: 655 - DNA, 21 bp, Artificial sequence
  Synthetic sequence: "human only" siRNA
  misc_feature (20)..(20): t is 2prime - deoxy - thymidine - 5prime - phosphorothioate
aauuacaccgucaacaacatt

SEQ ID NO: 656 - DNA, 21 bp, Artificial sequence
  Synthetic sequence: "human only" siRNA
  misc_feature (20)..(20): t is 2prime - deoxy - thymidine - 5prime - phosphorothioate
uguuguugacgguguaauutt

SEQ ID NO: 657 - DNA, 21 bp, Artificial sequence
  Synthetic sequence: "human only" siRNA
  misc_feature (20)..(20): t is 2prime - deoxy - thymidine - 5prime - phosphorothioate
aacugccguugauguguggtt

SEQ ID NO: 658 - DNA, 21 bp, Artificial sequence
  Synthetic sequence: "human only" siRNA
  misc_feature (20)..(20): t is 2prime - deoxy - thymidine - 5prime - phosphorothioate
ccacacaucaacggcaguutt

SEQ ID NO: 659 - DNA, 21 bp, Artificial sequence
  Synthetic sequence: "human only" siRNA
  misc_feature (20)..(20): t is 2prime - deoxy - thymidine - 5prime - phosphorothioate
aacugcggcuaagucucuutt

SEQ ID NO: 660 - DNA, 21 bp, Artificial sequence
  Synthetic sequence: "human only" siRNA
  misc_feature (20)..(20): t is 2prime - deoxy - thymidine - 5prime - phosphorothioate
aagagacuuagccgcaguutt

SEQ ID NO: 661 - DNA, 21 bp, Artificial sequence
  Synthetic sequence: "human only" siRNA
  misc_feature (20)..(20): t is 2prime - deoxy - thymidine - 5prime - phosphorothioate
ccgcugauaaccaggacaatt

SEQ ID NO: 662 - DNA, 21 bp, Artificial sequence
  Synthetic sequence: "human only" siRNA
  misc_feature (20)..(20): t is 2prime - deoxy - thymidine - 5prime - phosphorothioate
uuguccugguuaucagcggtt

SEQ ID NO: 663 - DNA, 21 bp, Artificial sequence
  Synthetic sequence: "human only" siRNA
  misc_feature (20)..(20): t is 2prime - deoxy - thymidine - 5prime - phosphorothioate
aaggguacacgcaggcaugtt

SEQ ID NO: 664 - DNA, 21 bp, Artificial sequence
  Synthetic sequence: "human only" siRNA
  misc_feature (20)..(20): t is 2prime - deoxy - thymidine - 5prime - phosphorothioate
caugccugcguguacccuutt

SEQ ID NO: 665 - DNA, 21 bp, Artificial sequence
  Synthetic sequence: "human only" siRNA
  misc_feature (20)..(20): t is 2prime - deoxy - thymidine - 5prime - phosphorothioate
ccggguaaguaaaggcagatt

SEQ ID NO: 666 - DNA, 21 bp, Artificial sequence
  Synthetic sequence: "human only" siRNA
  misc_feature (20)..(20): t is 2prime - deoxy - thymidine - 5prime - phosphorothioate
ucugccuuuacuuacccggtt

SEQ ID NO: 667 - DNA, 21 bp, Artificial sequence
  Synthetic sequence: "human only" siRNA
  misc_feature (20)..(20): t is 2prime - deoxy - thymidine - 5prime - phosphorothioate
cccauaccaggucucauggtt

SEQ ID NO: 668 - DNA, 21 bp, Artificial sequence
  Synthetic sequence: "human only" siRNA
  misc_feature (20)..(20): t is 2prime - deoxy - thymidine - 5prime - phosphorothioate
ccaugagaccugguaugggtt

SEQ ID NO: 669 - DNA, 21 bp, Artificial sequence
  Synthetic sequence: "human only" siRNA
  misc_feature (20)..(20): t is 2prime - deoxy - thymidine - 5prime - phosphorothioate
auuauggcgacugcaccaatt

SEQ ID NO: 670 - DNA, 21 bp, Artificial sequence
  Synthetic sequence: "human only" siRNA
  misc_feature (20)..(20): t is 2prime - deoxy - thymidine - 5prime - phosphorothioate
uuggugcagucgccauaautt

SEQ ID NO: 671 - DNA, 21 bp, Artificial sequence
  Synthetic sequence: "human only" siRNA
  misc_feature (20)..(20): t is 2prime - deoxy - thymidine - 5prime - phosphorothioate
augcacggguuuccugccctt

SEQ ID NO: 672 - DNA, 21 bp, Artificial sequence
  Synthetic sequence: "human only" siRNA
  misc_feature (20)..(20): t is 2prime - deoxy - thymidine - 5prime - phosphorothioate
gggcaggaaacccgugcautt

SEQ ID NO: 673 - DNA, 21 bp, Artificial sequence
  Synthetic sequence: "human only" siRNA
  misc_feature (20)..(20): t is 2prime - deoxy - thymidine - 5prime - phosphorothioate
cuagcccuccacaguccactt

SEQ ID NO: 674 - DNA, 21 bp, Artificial sequence
  Synthetic sequence: "human only" siRNA
  misc_feature (20)..(20): t is 2prime - deoxy - thymidine - 5prime - phosphorothioate
guggacuguggagggcuagtt

SEQ ID NO: 675 - DNA, 21 bp, Artificial sequence
  Synthetic sequence: "human only" siRNA
  misc_feature (20)..(20): t is 2prime - deoxy - thymidine - 5prime - phosphorothioate
cagguacccggaaauuaaatt

SEQ ID NO: 676 - DNA, 21 bp, Artificial sequence
  Synthetic sequence: "human only" siRNA
  misc_feature (20)..(20): t is 2prime - deoxy - thymidine - 5prime - phosphorothioate
uuuaauuuccggguaccugtt

SEQ ID NO: 677 - DNA, 21 bp, Artificial sequence
  Synthetic sequence: "human only" siRNA
  misc_feature (20)..(20): t is 2prime - deoxy - thymidine - 5prime - phosphorothioate
aauacagcuccuucaccactt

SEQ ID NO: 678 - DNA, 21 bp, Artificial sequence
  Synthetic sequence: "human only" siRNA
  misc_feature (20)..(20): t is 2prime - deoxy - thymidine - 5prime - phosphorothioate
guggugaaggagcuguauutt

SEQ ID NO: 679 - DNA, 21 bp, Artificial sequence
  Synthetic sequence: "human only" siRNA
  misc_feature (20)..(20): t is 2prime - deoxy - thymidine - 5prime - phosphorothioate
cacggguuuccugcccagctt

SEQ ID NO: 680 - DNA, 21 bp, Artificial sequence
  Synthetic sequence: "human only" siRNA
  misc_feature (20)..(20): t is 2prime - deoxy - thymidine - 5prime - phosphorothioate
gcugggcaggaaacccgugtt

SEQ ID NO: 681 - DNA, 21 bp, Artificial sequence
  Synthetic sequence: "human only" siRNA
  misc_feature (20)..(20): t is 2prime - deoxy - thymidine - 5prime - phosphorothioate
ggacugaaucuugcccguutt

SEQ ID NO: 682 - DNA, 21 bp, Artificial sequence
  Synthetic sequence: "human only" siRNA
  misc_feature (20)..(20): t is 2prime - deoxy - thymidine - 5prime - phosphorothioate
aacgggcaagauucagucctt

SEQ ID NO: 683 - DNA, 21 bp, Artificial sequence
  Synthetic sequence: "human only" siRNA
  misc_feature (20)..(20): t is 2prime - deoxy - thymidine - 5prime - phosphorothioate
cguuuauguaugcuccaugtt

SEQ ID NO: 684 - DNA, 21 bp, Artificial sequence
  Synthetic sequence: "human only" siRNA
  misc_feature (20)..(20): t is 2prime - deoxy - thymidine - 5prime - phosphorothioate
cauggagcauacauaaacgtt

SEQ ID NO: 685 - DNA, 21 bp, Artificial sequence
  Synthetic sequence: "human only" siRNA
  misc_feature (20)..(20): t is 2prime - deoxy - thymidine - 5prime - phosphorothioate
ggguacugcuacuauaagctt

SEQ ID NO: 686 - DNA, 21 bp, Artificial sequence
  Synthetic sequence: "human only" siRNA
  misc_feature (20)..(20): t is 2prime - deoxy - thymidine - 5prime - phosphorothioate
gcuuauaguagcaguaccctt

SEQ ID NO: 687 - DNA, 21 bp, Artificial sequence
  Synthetic sequence: "human only" siRNA
  misc_feature (20)..(20): t is 2prime - deoxy - thymidine - 5prime - phosphorothioate
ucgguguugucugugguggtt

SEQ ID NO: 688 - DNA, 21 bp, Artificial sequence
  Synthetic sequence: "human only" siRNA
  misc_feature (20)..(20): t is 2prime - deoxy - thymidine - 5prime - phosphorothioate
ccaccacagacaacaccgatt

SEQ ID NO: 689 - DNA, 21 bp, Artificial sequence
  Synthetic sequence: "human only" siRNA
  misc_feature (20)..(20): t is 2prime - deoxy - thymidine - 5prime - phosphorothioate
aaacugccguugaugugugtt

SEQ ID NO: 690 - DNA, 21 bp, Artificial sequence
  Synthetic sequence: "human only" siRNA
  misc_feature (20)..(20): t is 2prime - deoxy - thymidine - 5prime - phosphorothioate
cacacaucaacggcaguuutt

SEQ ID NO: 691 - DNA, 21 bp, Artificial sequence
  Synthetic sequence: "human only" siRNA
  misc_feature (20)..(20): t is 2prime - deoxy - thymidine - 5prime - phosphorothioate
gcgaaacuuggagcuuugatt

SEQ ID NO: 692 - DNA, 21 bp, Artificial sequence
  Synthetic sequence: "human only" siRNA
  misc_feature (20)..(20): t is 2prime - deoxy - thymidine - 5prime - phosphorothioate
ucaaagcuccaaguuucgctt

SEQ ID NO: 693 - DNA, 21 bp, Artificial sequence
  Synthetic sequence: "human only" siRNA
  misc_feature (20)..(20): t is 2prime - deoxy - thymidine - 5prime - phosphorothioate
ggcccgucgagcccguagctt

SEQ ID NO: 694 - DNA, 21 bp, Artificial sequence
  Synthetic sequence: "human only" siRNA
  misc_feature (20)..(20): t is 2prime - deoxy - thymidine - 5prime - phosphorothioate
gcuacgggcucgacgggcctt

SEQ ID NO: 695 - DNA, 21 bp, Artificial sequence
  Synthetic sequence: "human only" siRNA
  misc_feature (20)..(20): t is 2prime - deoxy - thymidine - 5prime - phosphorothioate
gcgacagaacaauuacacctt

SEQ ID NO: 696 - DNA, 21 bp, Artificial sequence
  Synthetic sequence: "human only" siRNA
  misc_feature (20)..(20): t is 2prime - deoxy - thymidine - 5prime - phosphorothioate
gguguaauuguucugucgctt

SEQ ID NO: 697 - DNA, 21 bp, Artificial sequence
  Synthetic sequence: "human only" siRNA
  misc_feature (20)..(20): t is 2prime - deoxy - thymidine - 5prime - phosphorothioate
gcgacggcuuaagccagcctt

SEQ ID NO: 698 - DNA, 21 bp, Artificial sequence
  Synthetic sequence: "human only" siRNA
  misc_feature (20)..(20): t is 2prime - deoxy - thymidine - 5prime - phosphorothioate
ggcuggcuuaagccgucgctt

SEQ ID NO: 699 - DNA, 21 bp, Artificial sequence
  Synthetic sequence: "human only" siRNA
  misc_feature (20)..(20): t is 2prime - deoxy - thymidine - 5prime - phosphorothioate
gacccggguaaguaaaggctt

SEQ ID NO: 700 - DNA, 21 bp, Artificial sequence
  Synthetic sequence: "human only" siRNA
  misc_feature (20)..(20): t is 2prime - deoxy - thymidine - 5prime - phosphorothioate
gccuuuacuuacccggguctt

SEQ ID NO: 701 - DNA, 21 bp, Artificial sequence
  Synthetic sequence: "human only" siRNA
  misc_feature (20)..(20): t is 2prime - deoxy - thymidine - 5prime - phosphorothioate
uugaucacuccgccuucuctt

SEQ ID NO: 702 - DNA, 21 bp, Artificial sequence
  Synthetic sequence: "human only" siRNA
  misc_feature (20)..(20): t is 2prime - deoxy - thymidine - 5prime - phosphorothioate
gagaaggcggagugaucaatt

SEQ ID NO: 703 - DNA, 21 bp, Artificial sequence
  Synthetic sequence: "human only" siRNA
  misc_feature (20)..(20): t is 2prime - deoxy - thymidine - 5prime - phosphorothioate
ucuagcccuccacaguccatt

SEQ ID NO: 704 - DNA, 21 bp, Artificial sequence
  Synthetic sequence: "human only" siRNA
  misc_feature (20)..(20): t is 2prime - deoxy - thymidine - 5prime - phosphorothioate
uggacuguggagggcuagatt

SEQ ID NO: 705 - DNA, 21 bp, Artificial sequence
  Synthetic sequence: "human only" siRNA
  misc_feature (20)..(20): t is 2prime - deoxy - thymidine - 5prime - phosphorothioate
guuucaccaagugccggaatt

SEQ ID NO: 706 - DNA, 21 bp, Artificial sequence
  Synthetic sequence: "human only" siRNA
  misc_feature (20)..(20): t is 2prime - deoxy - thymidine - 5prime - phosphorothioate
uuccggcacuuggugaaactt

SEQ ID NO: 707 - DNA, 21 bp, Artificial sequence
  Synthetic sequence: "human only" siRNA
  misc_feature (20)..(20): t is 2prime - deoxy - thymidine - 5prime - phosphorothioate
cucaacucggacaagcucgtt

SEQ ID NO: 708 - DNA, 21 bp, Artificial sequence
  Synthetic sequence: "human only" siRNA
  misc_feature (20)..(20): t is 2prime - deoxy - thymidine - 5prime - phosphorothioate
cgagcuuguccgaguugagtt

SEQ ID NO: 709 - DNA, 21 bp, Artificial sequence
  Synthetic sequence: "human only" siRNA
  misc_feature (20)..(20): t is 2prime - deoxy - thymidine - 5prime - phosphorothioate
caacucggacaagcucguctt

SEQ ID NO: 710 - DNA, 21 bp, Artificial sequence
  Synthetic sequence: "human only" siRNA
  misc_feature (20)..(20): t is 2prime - deoxy - thymidine - 5prime - phosphorothioate
gacgagcuuguccgaguugtt

SEQ ID NO: 711 - DNA, 21 bp, Artificial sequence
  Synthetic sequence: "human only" siRNA
  misc_feature (20)..(20): t is 2prime - deoxy - thymidine - 5prime - phosphorothioate
acccggaaauuaaagaggatt

SEQ ID NO: 712 - DNA, 21 bp, Artificial sequence
  Synthetic sequence: "human only" siRNA
  misc_feature (20)..(20): t is 2prime - deoxy - thymidine - 5prime - phosphorothioate
uccucuuuaauuuccgggutt

SEQ ID NO: 713 - DNA, 21 bp, Artificial sequence
  Synthetic sequence: "human only" siRNA
  misc_feature (20)..(20): t is 2prime - deoxy - thymidine - 5prime - phosphorothioate
cccggaaauuaaagaggagtt

SEQ ID NO: 714 - DNA, 21 bp, Artificial sequence
  Synthetic sequence: "human only" siRNA
  misc_feature (20)..(20): t is 2prime - deoxy - thymidine - 5prime - phosphorothioate
cuccucuuuaauuuccgggtt

SEQ ID NO: 715 - DNA, 21 bp, Artificial sequence
  Synthetic sequence: "human only" siRNA
  misc_feature (20)..(20): t is 2prime - deoxy - thymidine - 5prime - phosphorothioate
caccacucucguggccggctt

SEQ ID NO: 716 - DNA, 21 bp, Artificial sequence
  Synthetic sequence: "human only" siRNA
  misc_feature (20)..(20): t is 2prime - deoxy - thymidine - 5prime - phosphorothioate
gccggccacgagaguggugtt

SEQ ID NO: 717 - DNA, 21 bp, Artificial sequence
  Synthetic sequence: "human only" siRNA
  misc_feature (20)..(20): t is 2prime - deoxy - thymidine - 5prime - phosphorothioate
cgucgagcccguagcguggtt

SEQ ID NO: 718 - DNA, 21 bp, Artificial sequence
  Synthetic sequence: "human only" siRNA
  misc_feature (20)..(20): t is 2prime - deoxy - thymidine - 5prime - phosphorothioate
ccacgcuacgggcucgacgtt

SEQ ID NO: 719 - DNA, 21 bp, Artificial sequence
  Synthetic sequence: "human only" siRNA
  misc_feature (20)..(20): t is 2prime - deoxy - thymidine - 5prime - phosphorothioate
gcuugcgggacaacaaccctt

SEQ ID NO: 720 - DNA, 21 bp, Artificial sequence
  Synthetic sequence: "human only" siRNA
  misc_feature (20)..(20): t is 2prime - deoxy - thymidine - 5prime - phosphorothioate
ggguuguugucccgcaagctt

SEQ ID NO: 721 - DNA, 21 bp, Artificial sequence
  Synthetic sequence: "human only" siRNA
  misc_feature (20)..(20): t is 2prime - deoxy - thymidine - 5prime - phosphorothioate
gaaucaacaacggucuguctt

SEQ ID NO: 722 - DNA, 21 bp, Artificial sequence
  Synthetic sequence: "human only" siRNA
  misc_feature (20)..(20): t is 2prime - deoxy - thymidine - 5prime - phosphorothioate
gacagaccguuguugauuctt

SEQ ID NO: 723 - DNA, 21 bp, Artificial sequence
  Synthetic sequence: "human only" siRNA
  misc_feature (20)..(20): t is 2prime - deoxy - thymidine - 5prime - phosphorothioate
gggcgauuauggcgacugctt

SEQ ID NO: 724 - DNA, 21 bp, Artificial sequence
  Synthetic sequence: "human only" siRNA
  misc_feature (20)..(20): t is 2prime - deoxy - thymidine - 5prime - phosphorothioate
gcagucgccauaaucgccctt

SEQ ID NO: 725 - DNA, 21 bp, Artificial sequence
  Synthetic sequence: "human only" siRNA
  misc_feature (20)..(20): t is 2prime - deoxy - thymidine - 5prime - phosphorothioate
cgauuauggcgacugcacctt

SEQ ID NO: 726 - DNA, 21 bp, Artificial sequence
  Synthetic sequence: "human only" siRNA
  misc_feature (20)..(20): t is 2prime - deoxy - thymidine - 5prime - phosphorothioate
ggugcagucgccauaaucgtt

SEQ ID NO: 727 - DNA, 21 bp, Artificial sequence
  Synthetic sequence: "human only" siRNA
  misc_feature (20)..(20): t is 2prime - deoxy - thymidine - 5prime - phosphorothioate
ucugcugguuacucacgautt

SEQ ID NO: 728 - DNA, 21 bp, Artificial sequence
  Synthetic sequence: "human only" siRNA
  misc_feature (20)..(20): t is 2prime - deoxy - thymidine - 5prime - phosphorothioate
aucgugaguaaccagcagatt

SEQ ID NO: 729 - DNA, 21 bp, Artificial sequence
  Synthetic sequence: "human only" siRNA
  misc_feature (20)..(20): t is 2prime - deoxy - thymidine - 5prime - phosphorothioate
cuaucgcgacagaacaauutt

SEQ ID NO: 730 - DNA, 21 bp, Artificial sequence
  Synthetic sequence: "human only" siRNA
  misc_feature (20)..(20): t is 2prime - deoxy - thymidine - 5prime - phosphorothioate
aauuguucugucgcgauagtt

SEQ ID NO: 731 - DNA, 21 bp, Artificial sequence
  Synthetic sequence: "human only" siRNA
  misc_feature (20)..(20): t is 2prime - deoxy - thymidine - 5prime - phosphorothioate
caauuacaccgucaacaactt

SEQ ID NO: 732 - DNA, 21 bp, Artificial sequence
  Synthetic sequence: "human only" siRNA
  misc_feature (20)..(20): t is 2prime - deoxy - thymidine - 5prime - phosphorothioate
guuguugacgguguaauugtt

SEQ ID NO: 733 - DNA, 21 bp, Artificial sequence
  Synthetic sequence: "human only" siRNA
  misc_feature (20)..(20): t is 2prime - deoxy - thymidine - 5prime - phosphorothioate
accgucaacaacaagagaatt

SEQ ID NO: 734 - DNA, 21 bp, Artificial sequence
  Synthetic sequence: "human only" siRNA
  misc_feature (20)..(20): t is 2prime - deoxy - thymidine - 5prime - phosphorothioate
uucucuuguuguugacggutt

SEQ ID NO: 735 - DNA, 21 bp, Artificial sequence
  Synthetic sequence: "human only" siRNA
  misc_feature (20)..(20): t is 2prime - deoxy - thymidine - 5prime - phosphorothioate
cuccucgguguugucugugtt

SEQ ID NO: 736 - DNA, 21 bp, Artificial sequence
  Synthetic sequence: "human only" siRNA
  misc_feature (20)..(20): t is 2prime - deoxy - thymidine - 5prime - phosphorothioate
cacagacaacaccgaggagtt

SEQ ID NO: 737 - DNA, 21 bp, Artificial sequence
  Synthetic sequence: "human only" siRNA
  misc_feature (20)..(20): t is 2prime - deoxy - thymidine - 5prime - phosphorothioate
ggagguagccuccacccugtt

SEQ ID NO: 738 - DNA, 21 bp, Artificial sequence
  Synthetic sequence: "human only" siRNA
  misc_feature (20)..(20): t is 2prime - deoxy - thymidine - 5prime - phosphorothioate
caggguggaggcuaccucctt

SEQ ID NO: 739 - DNA, 21 bp, Artificial sequence
  Synthetic sequence: "human only" siRNA
  misc_feature (20)..(20): t is 2prime - deoxy - thymidine - 5prime - phosphorothioate
ggagagguuucucacaccatt

SEQ ID NO: 740 - DNA, 21 bp, Artificial sequence
  Synthetic sequence: "human only" siRNA
  misc_feature (20)..(20): t is 2prime - deoxy - thymidine - 5prime - phosphorothioate
uggugugagaaaccucucctt

SEQ ID NO: 741 - DNA, 21 bp, Artificial sequence
  Synthetic sequence: "human only" siRNA
  misc_feature (20)..(20): t is 2prime - deoxy - thymidine - 5prime - phosphorothioate
cugccguugauguguggagtt

SEQ ID NO: 742 - DNA, 21 bp, Artificial sequence
  Synthetic sequence: "human only" siRNA
  misc_feature (20)..(20): t is 2prime - deoxy - thymidine - 5prime - phosphorothioate
cuccacacaucaacggcagtt

SEQ ID NO: 743 - DNA, 21 bp, Artificial sequence
  Synthetic sequence: "human only" siRNA
  misc_feature (20)..(20): t is 2prime - deoxy - thymidine - 5prime - phosphorothioate
ugccguugauguguggaggtt

SEQ ID NO: 744 - DNA, 21 bp, Artificial sequence
  Synthetic sequence: "human only" siRNA
  misc_feature (20)..(20): t is 2prime - deoxy - thymidine - 5prime - phosphorothioate
ccuccacacaucaacggcatt

SEQ ID NO: 745 - DNA, 21 bp, Artificial sequence
  Synthetic sequence: "human only" siRNA
  misc_feature (20)..(20): t is 2prime - deoxy - thymidine - 5prime - phosphorothioate
agauggguaagggcucaggtt

SEQ ID NO: 746 - DNA, 21 bp, Artificial sequence
  Synthetic sequence: "human only" siRNA
  misc_feature (20)..(20): t is 2prime - deoxy - thymidine - 5prime - phosphorothioate
ccugagcccuuacccaucutt

SEQ ID NO: 747 - DNA, 21 bp, Artificial sequence
  Synthetic sequence: "human only" siRNA
  misc_feature (20)..(20): t is 2prime - deoxy - thymidine - 5prime - phosphorothioate
agaacaguagcugaugaagtt

SEQ ID NO: 748 - DNA, 21 bp, Artificial sequence
  Synthetic sequence: "human only" siRNA
  misc_feature (20)..(20): t is 2prime - deoxy - thymidine - 5prime - phosphorothioate
cuucaucagcuacuguucutt

SEQ ID NO: 749 - DNA, 21 bp, Artificial sequence
  Synthetic sequence: "human only" siRNA
  misc_feature (20)..(20): t is 2prime - deoxy - thymidine - 5prime - phosphorothioate
gcggcuaagucucuuuuuctt

SEQ ID NO: 750 - DNA, 21 bp, Artificial sequence
  Synthetic sequence: "human only" siRNA
  misc_feature (20)..(20): t is 2prime - deoxy - thymidine - 5prime - phosphorothioate
gaaaaagagacuuagccgctt

SEQ ID NO: 751 - DNA, 21 bp, Artificial sequence
  Synthetic sequence: "human only" siRNA
  misc_feature (20)..(20): t is 2prime - deoxy - thymidine - 5prime - phosphorothioate
ccuaagaaaccgcugauaatt

SEQ ID NO: 752 - DNA, 21 bp, Artificial sequence
  Synthetic sequence: "human only" siRNA
  misc_feature (20)..(20): t is 2prime - deoxy - thymidine - 5prime - phosphorothioate
uuaucagcgguuucuuaggtt

SEQ ID NO: 753 - DNA, 21 bp, Artificial sequence
  Synthetic sequence: "human only" siRNA
  misc_feature (20)..(20): t is 2prime - deoxy - thymidine - 5prime - phosphorothioate
gaaaccgcugauaaccaggtt

SEQ ID NO: 754 - DNA, 21 bp, Artificial sequence
  Synthetic sequence: "human only" siRNA
  misc_feature (20)..(20): t is 2prime - deoxy - thymidine - 5prime - phosphorothioate
ccugguuaucagcgguuuctt

SEQ ID NO: 755 - DNA, 21 bp, Artificial sequence
  Synthetic sequence: "human only" siRNA
  misc_feature (20)..(20): t is 2prime - deoxy - thymidine - 5prime - phosphorothioate
aaccgcugauaaccaggactt

SEQ ID NO: 756 - DNA, 21 bp, Artificial sequence
  Synthetic sequence: "human only" siRNA
  misc_feature (20)..(20): t is 2prime - deoxy - thymidine - 5prime - phosphorothioate
guccugguuaucagcgguutt

SEQ ID NO: 757 - DNA, 21 bp, Artificial sequence
  Synthetic sequence: "human only" siRNA
  misc_feature (20)..(20): t is 2prime - deoxy - thymidine - 5prime - phosphorothioate
accgcugauaaccaggacatt

SEQ ID NO: 758 - DNA, 21 bp, Artificial sequence
  Synthetic sequence: "human only" siRNA
  misc_feature (20)..(20): t is 2prime - deoxy - thymidine - 5prime - phosphorothioate
uguccugguuaucagcggutt

SEQ ID NO: 759 - DNA, 21 bp, Artificial sequence
  Synthetic sequence: "human only" siRNA
  misc_feature (20)..(20): t is 2prime - deoxy - thymidine - 5prime - phosphorothioate
ccaaggguacacgcaggcatt

SEQ ID NO: 760 - DNA, 21 bp, Artificial sequence
  Synthetic sequence: "human only" siRNA
  misc_feature (20)..(20): t is 2prime - deoxy - thymidine - 5prime - phosphorothioate
ugccugcguguacccuuggtt

SEQ ID NO: 761 - DNA, 21 bp, Artificial sequence
  Synthetic sequence: "human only" siRNA
  misc_feature (20)..(20): t is 2prime - deoxy - thymidine - 5prime - phosphorothioate
caaggguacacgcaggcautt

SEQ ID NO: 762 - DNA, 21 bp, Artificial sequence
  Synthetic sequence: "human only" siRNA
  misc_feature (20)..(20): t is 2prime - deoxy - thymidine - 5prime - phosphorothioate
augccugcguguacccuugtt

SEQ ID NO: 763 - DNA, 21 bp, Artificial sequence
  Synthetic sequence: "human only" siRNA
  misc_feature (20)..(20): t is 2prime - deoxy - thymidine - 5prime - phosphorothioate
aggguacacgcaggcaugctt

SEQ ID NO: 764 - DNA, 21 bp, Artificial sequence
  Synthetic sequence: "human only" siRNA
  misc_feature (20)..(20): t is 2prime - deoxy - thymidine - 5prime - phosphorothioate
gcaugccugcguguacccutt

SEQ ID NO: 765 - DNA, 21 bp, Artificial sequence
  Synthetic sequence: "human only" siRNA
  misc_feature (20)..(20): t is 2prime - deoxy - thymidine - 5prime - phosphorothioate
guacacgcaggcaugcacgtt

SEQ ID NO: 766 - DNA, 21 bp, Artificial sequence
  Synthetic sequence: "human only" siRNA
  misc_feature (20)..(20): t is 2prime - deoxy - thymidine - 5prime - phosphorothioate
cgugcaugccugcguguactt

SEQ ID NO: 767 - DNA, 21 bp, Artificial sequence
  Synthetic sequence: "human only" siRNA
  misc_feature (20)..(20): t is 2prime - deoxy - thymidine - 5prime - phosphorothioate
aggcaugcacggguuuccutt

SEQ ID NO: 768 - DNA, 21 bp, Artificial sequence
  Synthetic sequence: "human only" siRNA
  misc_feature (20)..(20): t is 2prime - deoxy - thymidine - 5prime - phosphorothioate
aggaaacccgugcaugccutt

SEQ ID NO: 769 - DNA, 21 bp, Artificial sequence
  Synthetic sequence: "human only" siRNA
  misc_feature (20)..(20): t is 2prime - deoxy - thymidine - 5prime - phosphorothioate
ggcaugcacggguuuccugtt

SEQ ID NO: 770 - DNA, 21 bp, Artificial sequence
  Synthetic sequence: "human only" siRNA
  misc_feature (20)..(20): t is 2prime - deoxy - thymidine - 5prime - phosphorothioate
caggaaacccgugcaugcctt

SEQ ID NO: 771 - DNA, 21 bp, Artificial sequence
  Synthetic sequence: "human only" siRNA
  misc_feature (20)..(20): t is 2prime - deoxy - thymidine - 5prime - phosphorothioate
acggguuuccugcccagcgtt

SEQ ID NO: 772 - DNA, 21 bp, Artificial sequence
  Synthetic sequence: "human only" siRNA
  misc_feature (20)..(20): t is 2prime - deoxy - thymidine - 5prime - phosphorothioate
cgcugggcaggaaacccgutt

SEQ ID NO: 773 - DNA, 21 bp, Artificial sequence
  Synthetic sequence: "human only" siRNA
  misc_feature (20)..(20): t is 2prime - deoxy - thymidine - 5prime - phosphorothioate
gagcagacccggguaaguatt

SEQ ID NO: 774 - DNA, 21 bp, Artificial sequence
  Synthetic sequence: "human only" siRNA
  misc_feature (20)..(20): t is 2prime - deoxy - thymidine - 5prime - phosphorothioate
uacuuacccgggucugcuctt

SEQ ID NO: 775 - DNA, 21 bp, Artificial sequence
  Synthetic sequence: "human only" siRNA
  misc_feature (20)..(20): t is 2prime - deoxy - thymidine - 5prime - phosphorothioate
agcagacccggguaaguaatt

SEQ ID NO: 776 - DNA, 21 bp, Artificial sequence
  Synthetic sequence: "human only" siRNA
  misc_feature (20)..(20): t is 2prime - deoxy - thymidine - 5prime - phosphorothioate
uuacuuacccgggucugcutt

SEQ ID NO: 777 - DNA, 21 bp, Artificial sequence
  Synthetic sequence: "human only" siRNA
  misc_feature (20)..(20): t is 2prime - deoxy - thymidine - 5prime - phosphorothioate
ggguaaguaaaggcagacctt

SEQ ID NO: 778 - DNA, 21 bp, Artificial sequence
  Synthetic sequence: "human only" siRNA
  misc_feature (20)..(20): t is 2prime - deoxy - thymidine - 5prime - phosphorothioate
ggucugccuuuacuuaccctt

SEQ ID NO: 779 - DNA, 21 bp, Artificial sequence
  Synthetic sequence: "human only" siRNA
  misc_feature (20)..(20): t is 2prime - deoxy - thymidine - 5prime - phosphorothioate
agccucauacccgugcccutt

SEQ ID NO: 780 - DNA, 21 bp, Artificial sequence
  Synthetic sequence: "human only" siRNA
  misc_feature (20)..(20): t is 2prime - deoxy - thymidine - 5prime - phosphorothioate
agggcacggguaugaggcutt

SEQ ID NO: 781 - DNA, 21 bp, Artificial sequence
  Synthetic sequence: "human only" siRNA
  misc_feature (20)..(20): t is 2prime - deoxy - thymidine - 5prime - phosphorothioate
gugaacgcuucugccacautt

SEQ ID NO: 782 - DNA, 21 bp, Artificial sequence
  Synthetic sequence: "human only" siRNA
  misc_feature (20)..(20): t is 2prime - deoxy - thymidine - 5prime - phosphorothioate
auguggcagaagcguucactt

SEQ ID NO: 783 - DNA, 21 bp, Artificial sequence
  Synthetic sequence: "human only" siRNA
  misc_feature (20)..(20): t is 2prime - deoxy - thymidine - 5prime - phosphorothioate
aaauugaucacuccgccuutt

SEQ ID NO: 784 - DNA, 21 bp, Artificial sequence
  Synthetic sequence: "human only" siRNA
  misc_feature (20)..(20): t is 2prime - deoxy - thymidine - 5prime - phosphorothioate
aaggcggagugaucaauuutt

SEQ ID NO: 785 - DNA, 21 bp, Artificial sequence
  Synthetic sequence: "human only" siRNA
  misc_feature (20)..(20): t is 2prime - deoxy - thymidine - 5prime - phosphorothioate
aauugaucacuccgccuuctt

SEQ ID NO: 786 - DNA, 21 bp, Artificial sequence
  Synthetic sequence: "human only" siRNA
  misc_feature (20)..(20): t is 2prime - deoxy - thymidine - 5prime - phosphorothioate
gaaggcggagugaucaauutt

SEQ ID NO: 787 - DNA, 21 bp, Artificial sequence
  Synthetic sequence: "human only" siRNA
  misc_feature (20)..(20): t is 2prime - deoxy - thymidine - 5prime - phosphorothioate
gccuugcggucagggacugtt

SEQ ID NO: 788 - DNA, 21 bp, Artificial sequence
  Synthetic sequence: "human only" siRNA
  misc_feature (20)..(20): t is 2prime - deoxy - thymidine - 5prime - phosphorothioate
cagucccugaccgcaaggctt

SEQ ID NO: 789 - DNA, 21 bp, Artificial sequence
  Synthetic sequence: "human only" siRNA
  misc_feature (20)..(20): t is 2prime - deoxy - thymidine - 5prime - phosphorothioate
cuugcggucagggacugaatt

SEQ ID NO: 790 - DNA, 21 bp, Artificial sequence
  Synthetic sequence: "human only" siRNA
  misc_feature (20)..(20): t is 2prime - deoxy - thymidine - 5prime - phosphorothioate
uucagucccugaccgcaagtt

SEQ ID NO: 791 - DNA, 21 bp, Artificial sequence
  Synthetic sequence: "human only" siRNA
  misc_feature (20)..(20): t is 2prime - deoxy - thymidine - 5prime - phosphorothioate
uugcggucagggacugaautt

SEQ ID NO: 792 - DNA, 21 bp, Artificial sequence
  Synthetic sequence: "human only" siRNA
  misc_feature (20)..(20): t is 2prime - deoxy - thymidine - 5prime - phosphorothioate
auucagucccugaccgcaatt

SEQ ID NO: 793 - DNA, 21 bp, Artificial sequence
  Synthetic sequence: "human only" siRNA
  misc_feature (20)..(20): t is 2prime - deoxy - thymidine - 5prime - phosphorothioate
auguaugcuccaugucuagtt

SEQ ID NO: 794 - DNA, 21 bp, Artificial sequence
  Synthetic sequence: "human only" siRNA
  misc_feature (20)..(20): t is 2prime - deoxy - thymidine - 5prime - phosphorothioate
cuagacauggagcauacautt

SEQ ID NO: 795 - DNA, 21 bp, Artificial sequence
  Synthetic sequence: "human only" siRNA
  misc_feature (20)..(20): t is 2prime - deoxy - thymidine - 5prime - phosphorothioate
agcaaguaggcaggagcuctt

SEQ ID NO: 796 - DNA, 21 bp, Artificial sequence
  Synthetic sequence: "human only" siRNA
  misc_feature (20)..(20): t is 2prime - deoxy - thymidine - 5prime - phosphorothioate
gagcuccugccuacuugcutt

SEQ ID NO: 797 - DNA, 21 bp, Artificial sequence
  Synthetic sequence: "human only" siRNA
  misc_feature (20)..(20): t is 2prime - deoxy - thymidine - 5prime - phosphorothioate
cagcccauaccaggucucatt

SEQ ID NO: 798 - DNA, 21 bp, Artificial sequence
  Synthetic sequence: "human only" siRNA
  misc_feature (20)..(20): t is 2prime - deoxy - thymidine - 5prime - phosphorothioate
ugagaccugguaugggcugtt

SEQ ID NO: 799 - DNA, 21 bp, Artificial sequence
  Synthetic sequence: "human only" siRNA
  misc_feature (20)..(20): t is 2prime - deoxy - thymidine - 5prime - phosphorothioate
cagccgucgcgaccugcggtt

SEQ ID NO: 800 - DNA, 21 bp, Artificial sequence
  Synthetic sequence: "human only" siRNA
  misc_feature (20)..(20): t is 2prime - deoxy - thymidine - 5prime - phosphorothioate
ccgcaggucgcgacggcugtt

SEQ ID NO: 801 - DNA, 21 bp, Artificial sequence
  Synthetic sequence: "human only" siRNA
  misc_feature (20)..(20): t is 2prime - deoxy - thymidine - 5prime - phosphorothioate
gggcccgucgagcccguagtt

SEQ ID NO: 802 - DNA, 21 bp, Artificial sequence
  Synthetic sequence: "human only" siRNA
  misc_feature (20)..(20): t is 2prime - deoxy - thymidine - 5prime - phosphorothioate
cuacgggcucgacgggccctt

SEQ ID NO: 803 - DNA, 21 bp, Artificial sequence
  Synthetic sequence: "human only" siRNA
  misc_feature (20)..(20): t is 2prime - deoxy - thymidine - 5prime - phosphorothioate
cguagcguggccuccagcutt

SEQ ID NO: 804 - DNA, 21 bp, Artificial sequence
  Synthetic sequence: "human only" siRNA
  misc_feature (20)..(20): t is 2prime - deoxy - thymidine - 5prime - phosphorothioate
agcuggaggccacgcuacgtt

SEQ ID NO: 805 - DNA, 21 bp, Artificial sequence
  Synthetic sequence: "human only" siRNA
  misc_feature (20)..(20): t is 2prime - deoxy - thymidine - 5prime - phosphorothioate
ggugagggagugguaccgctt

SEQ ID NO: 806 - DNA, 21 bp, Artificial sequence
  Synthetic sequence: "human only" siRNA
  misc_feature (20)..(20): t is 2prime - deoxy - thymidine - 5prime - phosphorothioate
gcgguaccacucccucacctt

SEQ ID NO: 807 - DNA, 21 bp, Artificial sequence
  Synthetic sequence: "human only" siRNA
  misc_feature (20)..(20): t is 2prime - deoxy - thymidine - 5prime - phosphorothioate
aaaguacacacagcaggugtt

SEQ ID NO: 808 - DNA, 21 bp, Artificial sequence
  Synthetic sequence: "human only" siRNA
  misc_feature (20)..(20): t is 2prime - deoxy - thymidine - 5prime - phosphorothioate
caccugcuguguguacuuutt

SEQ ID NO: 809 - DNA, 21 bp, Artificial sequence
  Synthetic sequence: "human only" siRNA
  misc_feature (20)..(20): t is 2prime - deoxy - thymidine - 5prime - phosphorothioate
ccagguugacuucuccucatt

SEQ ID NO: 810 - DNA, 21 bp, Artificial sequence
  Synthetic sequence: "human only" siRNA
  misc_feature (20)..(20): t is 2prime - deoxy - thymidine - 5prime - phosphorothioate
ugaggagaagucaaccuggtt

SEQ ID NO: 811 - DNA, 21 bp, Artificial sequence
  Synthetic sequence: "human only" siRNA
  misc_feature (20)..(20): t is 2prime - deoxy - thymidine - 5prime - phosphorothioate
uguuucaccaagugccggatt

SEQ ID NO: 812 - DNA, 21 bp, Artificial sequence
  Synthetic sequence: "human only" siRNA
  misc_feature (20)..(20): t is 2prime - deoxy - thymidine - 5prime - phosphorothioate
uccggcacuuggugaaacatt

SEQ ID NO: 813 - DNA, 21 bp, Artificial sequence
  Synthetic sequence: "human only" siRNA
  misc_feature (20)..(20): t is 2prime - deoxy - thymidine - 5prime - phosphorothioate
ugcugguuacucacgauggtt

SEQ ID NO: 814 - DNA, 21 bp, Artificial sequence
  Synthetic sequence: "human only" siRNA
  misc_feature (20)..(20): t is 2prime - deoxy - thymidine - 5prime - phosphorothioate
ccaucgugaguaaccagcatt

SEQ ID NO: 815 - DNA, 21 bp, Artificial sequence
  Synthetic sequence: "human only" siRNA
  misc_feature (20)..(20): t is 2prime - deoxy - thymidine - 5prime - phosphorothioate
uccucgguguugucuguggtt

SEQ ID NO: 816 - DNA, 21 bp, Artificial sequence
  Synthetic sequence: "human only" siRNA
  misc_feature (20)..(20): t is 2prime - deoxy - thymidine - 5prime - phosphorothioate
ccacagacaacaccgaggatt

SEQ ID NO: 817 - DNA, 21 bp, Artificial sequence
  Synthetic sequence: "human only" siRNA
  misc_feature (20)..(20): t is 2prime - deoxy - thymidine - 5prime - phosphorothioate
agguagccuccacccuggctt

SEQ ID NO: 818 - DNA, 21 bp, Artificial sequence
  Synthetic sequence: "human only" siRNA
  misc_feature (20)..(20): t is 2prime - deoxy - thymidine - 5prime - phosphorothioate
gccaggguggaggcuaccutt

SEQ ID NO: 819 - DNA, 21 bp, Artificial sequence
  Synthetic sequence: "human only" siRNA
  misc_feature (20)..(20): t is 2prime - deoxy - thymidine - 5prime - phosphorothioate
gccguugauguguggagggtt

SEQ ID NO: 820 - DNA, 21 bp, Artificial sequence
  Synthetic sequence: "human only" siRNA
  misc_feature (20)..(20): t is 2prime - deoxy - thymidine - 5prime - phosphorothioate
cccuccacacaucaacggctt

SEQ ID NO: 821 - DNA, 21 bp, Artificial sequence
  Synthetic sequence: "human only" siRNA
  misc_feature (20)..(20): t is 2prime - deoxy - thymidine - 5prime - phosphorothioate
gauggguaagggcucaggatt

SEQ ID NO: 822 - DNA, 21 bp, Artificial sequence
  Synthetic sequence: "human only" siRNA
  misc_feature (20)..(20): t is 2prime - deoxy - thymidine - 5prime - phosphorothioate
uccugagcccuuacccauctt

SEQ ID NO: 823 - DNA, 21 bp, Artificial sequence
  Synthetic sequence: "human only" siRNA
  misc_feature (20)..(20): t is 2prime - deoxy - thymidine - 5prime - phosphorothioate
cccaacugcggcuaagucutt

SEQ ID NO: 824 - DNA, 21 bp, Artificial sequence
  Synthetic sequence: "human only" siRNA
  misc_feature (20)..(20): t is 2prime - deoxy - thymidine - 5prime - phosphorothioate
agacuuagccgcaguugggtt

SEQ ID NO: 825 - DNA, 21 bp, Artificial sequence
  Synthetic sequence: "human only" siRNA
  misc_feature (20)..(20): t is 2prime - deoxy - thymidine - 5prime - phosphorothioate
ccaagcgaaacuuggagcutt

SEQ ID NO: 826 - DNA, 21 bp, Artificial sequence
  Synthetic sequence: "human only" siRNA
  misc_feature (20)..(20): t is 2prime - deoxy - thymidine - 5prime - phosphorothioate
agcuccaaguuucgcuuggtt

SEQ ID NO: 827 - DNA, 21 bp, Artificial sequence
  Synthetic sequence: "human only" siRNA
  misc_feature (20)..(20): t is 2prime - deoxy - thymidine - 5prime - phosphorothioate
ggguacacgcaggcaugcatt

SEQ ID NO: 828 - DNA, 21 bp, Artificial sequence
  Synthetic sequence: "human only" siRNA
  misc_feature (20)..(20): t is 2prime - deoxy - thymidine - 5prime - phosphorothioate
ugcaugccugcguguaccctt

SEQ ID NO: 829 - DNA, 21 bp, Artificial sequence
  Synthetic sequence: "human only" siRNA
  misc_feature (20)..(20): t is 2prime - deoxy - thymidine - 5prime - phosphorothioate
ugcacggguuuccugcccatt

SEQ ID NO: 830 - DNA, 21 bp, Artificial sequence
  Synthetic sequence: "human only" siRNA
  misc_feature (20)..(20): t is 2prime - deoxy - thymidine - 5prime - phosphorothioate
ugggcaggaaacccgugcatt

SEQ ID NO: 831 - DNA, 21 bp, Artificial sequence
  Synthetic sequence: "human only" siRNA
  misc_feature (20)..(20): t is 2prime - deoxy - thymidine - 5prime - phosphorothioate
cuccucuagccucauaccctt

SEQ ID NO: 832 - DNA, 21 bp, Artificial sequence
  Synthetic sequence: "human only" siRNA
  misc_feature (20)..(20): t is 2prime - deoxy - thymidine - 5prime - phosphorothioate
ggguaugaggcuagaggagtt

SEQ ID NO: 833 - DNA, 21 bp, Artificial sequence
  Synthetic sequence: "human only" siRNA
  misc_feature (20)..(20): t is 2prime - deoxy - thymidine - 5prime - phosphorothioate
uccucuagccucauacccgtt

SEQ ID NO: 834 - DNA, 21 bp, Artificial sequence
  Synthetic sequence: "human only" siRNA
  misc_feature (20)..(20): t is 2prime - deoxy - thymidine - 5prime - phosphorothioate
cggguaugaggcuagaggatt

SEQ ID NO: 835 - DNA, 21 bp, Artificial sequence
  Synthetic sequence: "human only" siRNA
  misc_feature (20)..(20): t is 2prime - deoxy - thymidine - 5prime - phosphorothioate
ucuagccucauacccgugctt

SEQ ID NO: 836 - DNA, 21 bp, Artificial sequence
  Synthetic sequence: "human only" siRNA
  misc_feature (20)..(20): t is 2prime - deoxy - thymidine - 5prime - phosphorothioate
gcacggguaugaggcuagatt

SEQ ID NO: 837 - DNA, 21 bp, Artificial sequence
  Synthetic sequence: "human only" siRNA
  misc_feature (20)..(20): t is 2prime - deoxy - thymidine - 5prime - phosphorothioate
uucauaccucuacaugucutt

SEQ ID NO: 838 - DNA, 21 bp, Artificial sequence
  Synthetic sequence: "human only" siRNA
  misc_feature (20)..(20): t is 2prime - deoxy - thymidine - 5prime - phosphorothioate
agacauguagagguaugaatt

SEQ ID NO: 839 - DNA, 21 bp, Artificial sequence
  Synthetic sequence: "human only" siRNA
  misc_feature (20)..(20): t is 2prime - deoxy - thymidine - 5prime - phosphorothioate
ucuacaugucugcuugagatt

SEQ ID NO: 840 - DNA, 21 bp, Artificial sequence
  Synthetic sequence: "human only" siRNA
  misc_feature (20)..(20): t is 2prime - deoxy - thymidine - 5prime - phosphorothioate
ucucaagcagacauguagatt

SEQ ID NO: 841 - DNA, 21 bp, Artificial sequence
  Synthetic sequence: "human only" siRNA
  misc_feature (20)..(20): t is 2prime - deoxy - thymidine - 5prime - phosphorothioate
auauuuccucagccugaaatt

SEQ ID NO: 842 - DNA, 21 bp, Artificial sequence
  Synthetic sequence: "human only" siRNA
  misc_feature (20)..(20): t is 2prime - deoxy - thymidine - 5prime - phosphorothioate
uuucaggcugaggaaauautt

SEQ ID NO: 843 - DNA, 21 bp, Artificial sequence
  Synthetic sequence: "human only" siRNA
  misc_feature (20)..(20): t is 2prime - deoxy - thymidine - 5prime - phosphorothioate
aacuccuaugcaucccuuatt

SEQ ID NO: 844 - DNA, 21 bp, Artificial sequence
  Synthetic sequence: "human only" siRNA
  misc_feature (20)..(20): t is 2prime - deoxy - thymidine - 5prime - phosphorothioate
uaagggaugcauaggaguutt

SEQ ID NO: 845 - DNA, 21 bp, Artificial sequence
  Synthetic sequence: "human only" siRNA
  misc_feature (20)..(20): t is 2prime - deoxy - thymidine - 5prime - phosphorothioate
gcaucccuuagaacccugctt

SEQ ID NO: 846 - DNA, 21 bp, Artificial sequence
  Synthetic sequence: "human only" siRNA
  misc_feature (20)..(20): t is 2prime - deoxy - thymidine - 5prime - phosphorothioate
gcaggguucuaagggaugctt

SEQ ID NO: 847 - DNA, 21 bp, Artificial sequence
  Synthetic sequence: "human only" siRNA
  misc_feature (20)..(20): t is 2prime - deoxy - thymidine - 5prime - phosphorothioate
ugaucacuccgccuucucctt

SEQ ID NO: 848 - DNA, 21 bp, Artificial sequence
  Synthetic sequence: "human only" siRNA
  misc_feature (20)..(20): t is 2prime - deoxy - thymidine - 5prime - phosphorothioate
ggagaaggcggagugaucatt

SEQ ID NO: 849 - DNA, 21 bp, Artificial sequence
  Synthetic sequence: "human only" siRNA
  misc_feature (20)..(20): t is 2prime - deoxy - thymidine - 5prime - phosphorothioate
uguaagugccuugcggucatt

SEQ ID NO: 850 - DNA, 21 bp, Artificial sequence
  Synthetic sequence: "human only" siRNA
  misc_feature (20)..(20): t is 2prime - deoxy - thymidine - 5prime - phosphorothioate
ugaccgcaaggcacuuacatt

SEQ ID NO: 851 - DNA, 21 bp, Artificial sequence
  Synthetic sequence: "human only" siRNA
  misc_feature (20)..(20): t is 2prime - deoxy - thymidine - 5prime - phosphorothioate
ccuugcggucagggacugatt

SEQ ID NO: 852 - DNA, 21 bp, Artificial sequence
  Synthetic sequence: "human only" siRNA
  misc_feature (20)..(20): t is 2prime - deoxy - thymidine - 5prime - phosphorothioate
ucagucccugaccgcaaggtt

SEQ ID NO: 853 - DNA, 21 bp, Artificial sequence
  Synthetic sequence: "human only" siRNA
  misc_feature (20)..(20): t is 2prime - deoxy - thymidine - 5prime - phosphorothioate
aaucuugcccguuuauguatt

SEQ ID NO: 854 - DNA, 21 bp, Artificial sequence
  Synthetic sequence: "human only" siRNA
  misc_feature (20)..(20): t is 2prime - deoxy - thymidine - 5prime - phosphorothioate
uacauaaacgggcaagauutt

SEQ ID NO: 855 - DNA, 21 bp, Artificial sequence
  Synthetic sequence: "human only" siRNA
  misc_feature (20)..(20): t is 2prime - deoxy - thymidine - 5prime - phosphorothioate
ccguuuauguaugcuccautt

SEQ ID NO: 856 - DNA, 21 bp, Artificial sequence
  Synthetic sequence: "human only" siRNA
  misc_feature (20)..(20): t is 2prime - deoxy - thymidine - 5prime - phosphorothioate
auggagcauacauaaacggtt

SEQ ID NO: 857 - DNA, 21 bp, Artificial sequence
  Synthetic sequence: "human only" siRNA
  misc_feature (20)..(20): t is 2prime - deoxy - thymidine - 5prime - phosphorothioate
uguaugcuccaugucuagctt

SEQ ID NO: 858 - DNA, 21 bp, Artificial sequence
  Synthetic sequence: "human only" siRNA
  misc_feature (20)..(20): t is 2prime - deoxy - thymidine - 5prime - phosphorothioate
gcuagacauggagcauacatt

SEQ ID NO: 859 - DNA, 21 bp, Artificial sequence
  Synthetic sequence: "human only" siRNA
  misc_feature (20)..(20): t is 2prime - deoxy - thymidine - 5prime - phosphorothioate
caugucuagcccaucaucctt

SEQ ID NO: 860 - DNA, 21 bp, Artificial sequence
  Synthetic sequence: "human only" siRNA
  misc_feature (20)..(20): t is 2prime - deoxy - thymidine - 5prime - phosphorothioate
ggaugaugggcuagacaugtt

SEQ ID NO: 861 - DNA, 21 bp, Artificial sequence
  Synthetic sequence: "human only" siRNA
  misc_feature (20)..(20): t is 2prime - deoxy - thymidine - 5prime - phosphorothioate
aguaggcaggagcucaauatt

SEQ ID NO: 862 - DNA, 21 bp, Artificial sequence
  Synthetic sequence: "human only" siRNA
  misc_feature (20)..(20): t is 2prime - deoxy - thymidine - 5prime - phosphorothioate
uauugagcuccugccuacutt

SEQ ID NO: 863 - DNA, 21 bp, Artificial sequence
  Synthetic sequence: "human only" siRNA
  misc_feature (20)..(20): t is 2prime - deoxy - thymidine - 5prime - phosphorothioate
ccuacagguacccggaaautt

SEQ ID NO: 864 - DNA, 21 bp, Artificial sequence
  Synthetic sequence: "human only" siRNA
  misc_feature (20)..(20): t is 2prime - deoxy - thymidine - 5prime - phosphorothioate
auuuccggguaccuguaggtt

SEQ ID NO: 865 - DNA, 21 bp, Artificial sequence
  Synthetic sequence: "human only" siRNA
  misc_feature (20)..(20): t is 2prime - deoxy - thymidine - 5prime - phosphorothioate
cccgucgagcccguagcgutt

SEQ ID NO: 866 - DNA, 21 bp, Artificial sequence
  Synthetic sequence: "human only" siRNA
  misc_feature (20)..(20): t is 2prime - deoxy - thymidine - 5prime - phosphorothioate
acgcuacgggcucgacgggtt

SEQ ID NO: 867 - DNA, 21 bp, Artificial sequence
  Synthetic sequence: "human only" siRNA
  misc_feature (20)..(20): t is 2prime - deoxy - thymidine - 5prime - phosphorothioate
gcggugagggagugguacctt

SEQ ID NO: 868 - DNA, 21 bp, Artificial sequence
  Synthetic sequence: "human only" siRNA
  misc_feature (20)..(20): t is 2prime - deoxy - thymidine - 5prime - phosphorothioate
gguaccacucccucaccgctt

SEQ ID NO: 869 - DNA, 21 bp, Artificial sequence
  Synthetic sequence: "human only" siRNA
  misc_feature (20)..(20): t is 2prime - deoxy - thymidine - 5prime - phosphorothioate
uuauggcgacugcaccaagtt

SEQ ID NO: 870 - DNA, 21 bp, Artificial sequence
  Synthetic sequence: "human only" siRNA
  misc_feature (20)..(20): t is 2prime - deoxy - thymidine - 5prime - phosphorothioate
cuuggugcagucgccauaatt

SEQ ID NO: 871 - DNA, 21 bp, Artificial sequence
  Synthetic sequence: "human only" siRNA
  misc_feature (20)..(20): t is 2prime - deoxy - thymidine - 5prime - phosphorothioate
cuauaagcuccagguugactt

SEQ ID NO: 872 - DNA, 21 bp, Artificial sequence
  Synthetic sequence: "human only" siRNA
  misc_feature (20)..(20): t is 2prime - deoxy - thymidine - 5prime - phosphorothioate
gucaaccuggagcuuauagtt

SEQ ID NO: 873 - DNA, 21 bp, Artificial sequence
  Synthetic sequence: "human only" siRNA
  misc_feature (20)..(20): t is 2prime - deoxy - thymidine - 5prime - phosphorothioate
uauaagcuccagguugacutt

SEQ ID NO: 874 - DNA, 21 bp, Artificial sequence
  Synthetic sequence: "human only" siRNA
  misc_feature (20)..(20): t is 2prime - deoxy - thymidine - 5prime - phosphorothioate
agucaaccuggagcuuauatt

SEQ ID NO: 875 - DNA, 21 bp, Artificial sequence
  Synthetic sequence: "human only" siRNA
  misc_feature (20)..(20): t is 2prime - deoxy - thymidine - 5prime - phosphorothioate
agguugacuucuccucagatt

SEQ ID NO: 876 - DNA, 21 bp, Artificial sequence
  Synthetic sequence: "human only" siRNA
  misc_feature (20)..(20): t is 2prime - deoxy - thymidine - 5prime - phosphorothioate
ucugaggagaagucaaccutt

SEQ ID NO: 877 - DNA, 21 bp, Artificial sequence
  Synthetic sequence: "human only" siRNA
  misc_feature (20)..(20): t is 2prime - deoxy - thymidine - 5prime - phosphorothioate
cugggcuguuucaccaagutt

SEQ ID NO: 878 - DNA, 21 bp, Artificial sequence
  Synthetic sequence: "human only" siRNA
  misc_feature (20)..(20): t is 2prime - deoxy - thymidine - 5prime - phosphorothioate
acuuggugaaacagcccagtt

SEQ ID NO: 879 - DNA, 21 bp, Artificial sequence
  Synthetic sequence: "human only" siRNA
  misc_feature (20)..(20): t is 2prime - deoxy - thymidine - 5prime - phosphorothioate
aacaauuacaccgucaacatt

SEQ ID NO: 880 - DNA, 21 bp, Artificial sequence
  Synthetic sequence: "human only" siRNA
  misc_feature (20)..(20): t is 2prime - deoxy - thymidine - 5prime - phosphorothioate
uguugacgguguaauuguutt

SEQ ID NO: 881 - DNA, 21 bp, Artificial sequence
  Synthetic sequence: "human only" siRNA
  misc_feature (20)..(20): t is 2prime - deoxy - thymidine - 5prime - phosphorothioate
uggguaagggcucaggaagtt

SEQ ID NO: 882 - DNA, 21 bp, Artificial sequence
  Synthetic sequence: "human only" siRNA
  misc_feature (20)..(20): t is 2prime - deoxy - thymidine - 5prime - phosphorothioate
cuuccugagcccuuacccatt

SEQ ID NO: 883 - DNA, 21 bp, Artificial sequence
  Synthetic sequence: "human only" siRNA
  misc_feature (20)..(20): t is 2prime - deoxy - thymidine - 5prime - phosphorothioate
ggguaagggcucaggaagutt

SEQ ID NO: 884 - DNA, 21 bp, Artificial sequence
  Synthetic sequence: "human only" siRNA
  misc_feature (20)..(20): t is 2prime - deoxy - thymidine - 5prime - phosphorothioate
acuuccugagcccuuaccctt

SEQ ID NO: 885 - DNA, 21 bp, Artificial sequence
  Synthetic sequence: "human only" siRNA
  misc_feature (20)..(20): t is 2prime - deoxy - thymidine - 5prime - phosphorothioate
cacccaacugcggcuaagutt

SEQ ID NO: 886 - DNA, 21 bp, Artificial sequence
  Synthetic sequence: "human only" siRNA
  misc_feature (20)..(20): t is 2prime - deoxy - thymidine - 5prime - phosphorothioate
acuuagccgcaguugggugtt

SEQ ID NO: 887 - DNA, 21 bp, Artificial sequence
  Synthetic sequence: "human only" siRNA
  misc_feature (20)..(20): t is 2prime - deoxy - thymidine - 5prime - phosphorothioate
acccaacugcggcuaaguctt

SEQ ID NO: 888 - DNA, 21 bp, Artificial sequence
  Synthetic sequence: "human only" siRNA
  misc_feature (20)..(20): t is 2prime - deoxy - thymidine - 5prime - phosphorothioate
gacuuagccgcaguugggutt

SEQ ID NO: 889 - DNA, 21 bp, Artificial sequence
  Synthetic sequence: "human only" siRNA
  misc_feature (20)..(20): t is 2prime - deoxy - thymidine - 5prime - phosphorothioate
ccaacugcggcuaagucuctt

SEQ ID NO: 890 - DNA, 21 bp, Artificial sequence
  Synthetic sequence: "human only" siRNA
  misc_feature (20)..(20): t is 2prime - deoxy - thymidine - 5prime - phosphorothioate
gagacuuagccgcaguuggtt

SEQ ID NO: 891 - DNA, 21 bp, Artificial sequence
  Synthetic sequence: "human only" siRNA
  misc_feature (20)..(20): t is 2prime - deoxy - thymidine - 5prime - phosphorothioate
cuuggaucagccaagcgaatt

SEQ ID NO: 892 - DNA, 21 bp, Artificial sequence
  Synthetic sequence: "human only" siRNA
  misc_feature (20)..(20): t is 2prime - deoxy - thymidine - 5prime - phosphorothioate
uucgcuuggcugauccaagtt

SEQ ID NO: 893 - DNA, 21 bp, Artificial sequence
  Synthetic sequence: "human only" siRNA
  misc_feature (20)..(20): t is 2prime - deoxy - thymidine - 5prime - phosphorothioate
gccaagcgaaacuuggagctt

SEQ ID NO: 894 - DNA, 21 bp, Artificial sequence
  Synthetic sequence: "human only" siRNA
  misc_feature (20)..(20): t is 2prime - deoxy - thymidine - 5prime - phosphorothioate
gcuccaaguuucgcuuggctt

SEQ ID NO: 895 - DNA, 21 bp, Artificial sequence
  Synthetic sequence: "human only" siRNA
  misc_feature (20)..(20): t is 2prime - deoxy - thymidine - 5prime - phosphorothioate
uccuaagaaaccgcugauatt

SEQ ID NO: 896 - DNA, 21 bp, Artificial sequence
  Synthetic sequence: "human only" siRNA
  misc_feature (20)..(20): t is 2prime - deoxy - thymidine - 5prime - phosphorothioate
uaucagcgguuucuuaggatt

SEQ ID NO: 897 - DNA, 21 bp, Artificial sequence
  Synthetic sequence: "human only" siRNA
  misc_feature (20)..(20): t is 2prime - deoxy - thymidine - 5prime - phosphorothioate
gcaugcacggguuuccugctt

SEQ ID NO: 898 - DNA, 21 bp, Artificial sequence
  Synthetic sequence: "human only" siRNA
  misc_feature (20)..(20): t is 2prime - deoxy - thymidine - 5prime - phosphorothioate
gcaggaaacccgugcaugctt

SEQ ID NO: 899 - DNA, 21 bp, Artificial sequence
  Synthetic sequence: "human only" siRNA
  misc_feature (20)..(20): t is 2prime - deoxy - thymidine - 5prime - phosphorothioate
uguuacuuaggcaauuccctt

SEQ ID NO: 900 - DNA, 21 bp, Artificial sequence
  Synthetic sequence: "human only" siRNA
  misc_feature (20)..(20): t is 2prime - deoxy - thymidine - 5prime - phosphorothioate
gggaauugccuaaguaacatt

SEQ ID NO: 901 - DNA, 21 bp, Artificial sequence
  Synthetic sequence: "human only" siRNA
  misc_feature (20)..(20): t is 2prime - deoxy - thymidine - 5prime - phosphorothioate
cuagggcuagagcagaccctt

SEQ ID NO: 902 - DNA, 21 bp, Artificial sequence
  Synthetic sequence: "human only" siRNA
  misc_feature (20)..(20): t is 2prime - deoxy - thymidine - 5prime - phosphorothioate
gggucugcucuagcccuagtt

SEQ ID NO: 903 - DNA, 21 bp, Artificial sequence
  Synthetic sequence: "human only" siRNA
  misc_feature (20)..(20): t is 2prime - deoxy - thymidine - 5prime - phosphorothioate
cucuagccucauacccgugtt

SEQ ID NO: 904 - DNA, 21 bp, Artificial sequence
  Synthetic sequence: "human only" siRNA
  misc_feature (20)..(20): t is 2prime - deoxy - thymidine - 5prime - phosphorothioate
cacggguaugaggcuagagtt

SEQ ID NO: 905 - DNA, 21 bp, Artificial sequence
  Synthetic sequence: "human only" siRNA
  misc_feature (20)..(20): t is 2prime - deoxy - thymidine - 5prime - phosphorothioate
uuagaacccugcucagacatt

SEQ ID NO: 906 - DNA, 21 bp, Artificial sequence
  Synthetic sequence: "human only" siRNA
  misc_feature (20)..(20): t is 2prime - deoxy - thymidine - 5prime - phosphorothioate
ugucugagcaggguucuaatt

SEQ ID NO: 907 - DNA, 21 bp, Artificial sequence
  Synthetic sequence: "human only" siRNA
  misc_feature (20)..(20): t is 2prime - deoxy - thymidine - 5prime - phosphorothioate
ugugaacgcuucugccacatt

SEQ ID NO: 908 - DNA, 21 bp, Artificial sequence
  Synthetic sequence: "human only" siRNA
  misc_feature (20)..(20): t is 2prime - deoxy - thymidine - 5prime - phosphorothioate
uguggcagaagcguucacatt

SEQ ID NO: 909 - DNA, 21 bp, Artificial sequence
  Synthetic sequence: "human only" siRNA
  misc_feature (20)..(20): t is 2prime - deoxy - thymidine - 5prime - phosphorothioate
auugaucacuccgccuucutt

SEQ ID NO: 910 - DNA, 21 bp, Artificial sequence
  Synthetic sequence: "human only" siRNA
  misc_feature (20)..(20): t is 2prime - deoxy - thymidine - 5prime - phosphorothioate
agaaggcggagugaucaautt

SEQ ID NO: 911 - DNA, 21 bp, Artificial sequence
  Synthetic sequence: "human only" siRNA
  misc_feature (20)..(20): t is 2prime - deoxy - thymidine - 5prime - phosphorothioate
ucacuccgccuucuccuggtt

SEQ ID NO: 912 - DNA, 21 bp, Artificial sequence
  Synthetic sequence: "human only" siRNA
  misc_feature (20)..(20): t is 2prime - deoxy - thymidine - 5prime - phosphorothioate
ccaggagaaggcggagugatt

SEQ ID NO: 913 - DNA, 21 bp, Artificial sequence
  Synthetic sequence: "human only" siRNA
  misc_feature (20)..(20): t is 2prime - deoxy - thymidine - 5prime - phosphorothioate
gcggucagggacugaaucutt

SEQ ID NO: 914 - DNA, 21 bp, Artificial sequence
  Synthetic sequence: "human only" siRNA
  misc_feature (20)..(20): t is 2prime - deoxy - thymidine - 5prime - phosphorothioate
agauucagucccugaccgctt

SEQ ID NO: 915 - DNA, 21 bp, Artificial sequence
  Synthetic sequence: "human only" siRNA
  misc_feature (20)..(20): t is 2prime - deoxy - thymidine - 5prime - phosphorothioate
ggucagggacugaaucuugtt

SEQ ID NO: 916 - DNA, 21 bp, Artificial sequence
  Synthetic sequence: "human only" siRNA
  misc_feature (20)..(20): t is 2prime - deoxy - thymidine - 5prime - phosphorothioate
caagauucagucccugacctt

SEQ ID NO: 917 - DNA, 21 bp, Artificial sequence
  Synthetic sequence: "human only" siRNA
  misc_feature (20)..(20): t is 2prime - deoxy - thymidine - 5prime - phosphorothioate
guaugcuccaugucuagcctt

SEQ ID NO: 918 - DNA, 21 bp, Artificial sequence
  Synthetic sequence: "human only" siRNA
  misc_feature (20)..(20): t is 2prime - deoxy - thymidine - 5prime - phosphorothioate
ggcuagacauggagcauactt

SEQ ID NO: 919 - DNA, 21 bp, Artificial sequence
  Synthetic sequence: "human only" siRNA
  misc_feature (20)..(20): t is 2prime - deoxy - thymidine - 5prime - phosphorothioate
ccaugucuagcccaucauctt

SEQ ID NO: 920 - DNA, 21 bp, Artificial sequence
  Synthetic sequence: "human only" siRNA
  misc_feature (20)..(20): t is 2prime - deoxy - thymidine - 5prime - phosphorothioate
gaugaugggcuagacauggtt

SEQ ID NO: 921 - DNA, 21 bp, Artificial sequence
  Synthetic sequence: "human only" siRNA
  misc_feature (20)..(20): t is 2prime - deoxy - thymidine - 5prime - phosphorothioate
gaucgaguuccaccgcucctt

SEQ ID NO: 922 - DNA, 21 bp, Artificial sequence
  Synthetic sequence: "human only" siRNA
  misc_feature (20)..(20): t is 2prime - deoxy - thymidine - 5prime - phosphorothioate
ggagcgguggaacucgauctt

SEQ ID NO: 923 - DNA, 21 bp, Artificial sequence
  Synthetic sequence: "human only" siRNA
  misc_feature (20)..(20): t is 2prime - deoxy - thymidine - 5prime - phosphorothioate
ggacucuagcccuccacagtt

SEQ ID NO: 924 - DNA, 21 bp, Artificial sequence
  Synthetic sequence: "human only" siRNA
  misc_feature (20)..(20): t is 2prime - deoxy - thymidine - 5prime - phosphorothioate
cuguggagggcuagagucctt

SEQ ID NO: 925 - DNA, 21 bp, Artificial sequence
  Synthetic sequence: "human only" siRNA
  misc_feature (20)..(20): t is 2prime - deoxy - thymidine - 5prime - phosphorothioate
ucaccacucucguggccggtt

SEQ ID NO: 926 - DNA, 21 bp, Artificial sequence
  Synthetic sequence: "human only" siRNA
  misc_feature (20)..(20): t is 2prime - deoxy - thymidine - 5prime - phosphorothioate
ccggccacgagaguggugatt

SEQ ID NO: 927 - DNA, 21 bp, Artificial sequence
  Synthetic sequence: "human only" siRNA
  misc_feature (20)..(20): t is 2prime - deoxy - thymidine - 5prime - phosphorothioate
cagcuugcgggacaacaactt

SEQ ID NO: 928 - DNA, 21 bp, Artificial sequence
  Synthetic sequence: "human only" siRNA
  misc_feature (20)..(20): t is 2prime - deoxy - thymidine - 5prime - phosphorothioate
guuguugucccgcaagcugtt

SEQ ID NO: 929 - DNA, 21 bp, Artificial sequence
  Synthetic sequence: "human only" siRNA
  misc_feature (20)..(20): t is 2prime - deoxy - thymidine - 5prime - phosphorothioate
caucuucuauccgcggccctt

SEQ ID NO: 930 - DNA, 21 bp, Artificial sequence
  Synthetic sequence: "human only" siRNA
  misc_feature (20)..(20): t is 2prime - deoxy - thymidine - 5prime - phosphorothioate
gggccgcggauagaagaugtt

SEQ ID NO: 931 - DNA, 21 bp, Artificial sequence
  Synthetic sequence: "human only" siRNA
  misc_feature (20)..(20): t is 2prime - deoxy - thymidine - 5prime - phosphorothioate
auaagcuccagguugacuutt

SEQ ID NO: 932 - DNA, 21 bp, Artificial sequence
  Synthetic sequence: "human only" siRNA
  misc_feature (20)..(20): t is 2prime - deoxy - thymidine - 5prime - phosphorothioate
aagucaaccuggagcuuautt

SEQ ID NO: 933 - DNA, 21 bp, Artificial sequence
  Synthetic sequence: "human only" siRNA
  misc_feature (20)..(20): t is 2prime - deoxy - thymidine - 5prime - phosphorothioate
cugcugguuacucacgaugtt

SEQ ID NO: 934 - DNA, 21 bp, Artificial sequence
  Synthetic sequence: "human only" siRNA
  misc_feature (20)..(20): t is 2prime - deoxy - thymidine - 5prime - phosphorothioate
caucgugaguaaccagcagtt

SEQ ID NO: 935 - DNA, 21 bp, Artificial sequence
  Synthetic sequence: "human only" siRNA
  misc_feature (20)..(20): t is 2prime - deoxy - thymidine - 5prime - phosphorothioate
gaacaauuacaccgucaactt

SEQ ID NO: 936 - DNA, 21 bp, Artificial sequence
  Synthetic sequence: "human only" siRNA
  misc_feature (20)..(20): t is 2prime - deoxy - thymidine - 5prime - phosphorothioate
guugacgguguaauuguuctt

SEQ ID NO: 937 - DNA, 21 bp, Artificial sequence
  Synthetic sequence: "human only" siRNA
  misc_feature (20)..(20): t is 2prime - deoxy - thymidine - 5prime - phosphorothioate
auuacaccgucaacaacaatt

SEQ ID NO: 938 - DNA, 21 bp, Artificial sequence
  Synthetic sequence: "human only" siRNA
  misc_feature (20)..(20): t is 2prime - deoxy - thymidine - 5prime - phosphorothioate
uuguuguugacgguguaautt

SEQ ID NO: 939 - DNA, 21 bp, Artificial sequence
  Synthetic sequence: "human only" siRNA
  misc_feature (20)..(20): t is 2prime - deoxy - thymidine - 5prime - phosphorothioate
cugugguucggcuccucggtt

SEQ ID NO: 940 - DNA, 21 bp, Artificial sequence
  Synthetic sequence: "human only" siRNA
  misc_feature (20)..(20): t is 2prime - deoxy - thymidine - 5prime - phosphorothioate
ccgaggagccgaaccacagtt

SEQ ID NO: 941 - DNA, 21 bp, Artificial sequence
  Synthetic sequence: "human only" siRNA
  misc_feature (20)..(20): t is 2prime - deoxy - thymidine - 5prime - phosphorothioate
gaagugccuuggcuccagctt

SEQ ID NO: 942 - DNA, 21 bp, Artificial sequence
  Synthetic sequence: "human only" siRNA
  misc_feature (20)..(20): t is 2prime - deoxy - thymidine - 5prime - phosphorothioate
gcuggagccaaggcacuuctt

SEQ ID NO: 943 - DNA, 21 bp, Artificial sequence
  Synthetic sequence: "human only" siRNA
  misc_feature (20)..(20): t is 2prime - deoxy - thymidine - 5prime - phosphorothioate
gaucagccaagcgaaacuutt

SEQ ID NO: 944 - DNA, 21 bp, Artificial sequence
  Synthetic sequence: "human only" siRNA
  misc_feature (20)..(20): t is 2prime - deoxy - thymidine - 5prime - phosphorothioate
aaguuucgcuuggcugauctt

SEQ ID NO: 945 - DNA, 21 bp, Artificial sequence
  Synthetic sequence: "human only" siRNA
  misc_feature (20)..(20): t is 2prime - deoxy - thymidine - 5prime - phosphorothioate
agaaaccgcugauaaccagtt

SEQ ID NO: 946 - DNA, 21 bp, Artificial sequence
  Synthetic sequence: "human only" siRNA
  misc_feature (20)..(20): t is 2prime - deoxy - thymidine - 5prime - phosphorothioate
cugguuaucagcgguuucutt

SEQ ID NO: 947 - DNA, 21 bp, Artificial sequence
  Synthetic sequence: "human only" siRNA
  misc_feature (20)..(20): t is 2prime - deoxy - thymidine - 5prime - phosphorothioate
ugauaaccaggacaaaacatt

SEQ ID NO: 948 - DNA, 21 bp, Artificial sequence
  Synthetic sequence: "human only" siRNA
  misc_feature (20)..(20): t is 2prime - deoxy - thymidine - 5prime - phosphorothioate
uguuuuguccugguuaucatt

SEQ ID NO: 949 - DNA, 21 bp, Artificial sequence
  Synthetic sequence: "human only" siRNA
  misc_feature (20)..(20): t is 2prime - deoxy - thymidine - 5prime - phosphorothioate
cacgcaggcaugcacgggutt

SEQ ID NO: 950 - DNA, 21 bp, Artificial sequence
  Synthetic sequence: "human only" siRNA
  misc_feature (20)..(20): t is 2prime - deoxy - thymidine - 5prime - phosphorothioate
acccgugcaugccugcgugtt

SEQ ID NO: 951 - DNA, 21 bp, Artificial sequence
  Synthetic sequence: "human only" siRNA
  misc_feature (20)..(20): t is 2prime - deoxy - thymidine - 5prime - phosphorothioate
gcucuccaguagcacagautt

SEQ ID NO: 952 - DNA, 21 bp, Artificial sequence
  Synthetic sequence: "human only" siRNA
  misc_feature (20)..(20): t is 2prime - deoxy - thymidine - 5prime - phosphorothioate
aucugugcuacuggagagctt

SEQ ID NO: 953 - DNA, 21 bp, Artificial sequence
  Synthetic sequence: "human only" siRNA
  misc_feature (20)..(20): t is 2prime - deoxy - thymidine - 5prime - phosphorothioate
cagacccggguaaguaaagtt

SEQ ID NO: 954 - DNA, 21 bp, Artificial sequence
  Synthetic sequence: "human only" siRNA
  misc_feature (20)..(20): t is 2prime - deoxy - thymidine - 5prime - phosphorothioate
cuuuacuuacccgggucugtt

SEQ ID NO: 955 - DNA, 21 bp, Artificial sequence
  Synthetic sequence: "human only" siRNA
  misc_feature (20)..(20): t is 2prime - deoxy - thymidine - 5prime - phosphorothioate
agacccggguaaguaaaggtt

SEQ ID NO: 956 - DNA, 21 bp, Artificial sequence
  Synthetic sequence: "human only" siRNA
  misc_feature (20)..(20): t is 2prime - deoxy - thymidine - 5prime - phosphorothioate
ccuuuacuuacccgggucutt

SEQ ID NO: 957 - DNA, 21 bp, Artificial sequence
  Synthetic sequence: "human only" siRNA
  misc_feature (20)..(20): t is 2prime - deoxy - thymidine - 5prime - phosphorothioate
aucacuccgccuucuccugtt

SEQ ID NO: 958 - DNA, 21 bp, Artificial sequence
  Synthetic sequence: "human only" siRNA
  misc_feature (20)..(20): t is 2prime - deoxy - thymidine - 5prime - phosphorothioate
caggagaaggcggagugautt

SEQ ID NO: 959 - DNA, 21 bp, Artificial sequence
  Synthetic sequence: "human only" siRNA
  misc_feature (20)..(20): t is 2prime - deoxy - thymidine - 5prime - phosphorothioate
cacuccgccuucuccugggtt

SEQ ID NO: 960 - DNA, 21 bp, Artificial sequence
  Synthetic sequence: "human only" siRNA
  misc_feature (20)..(20): t is 2prime - deoxy - thymidine - 5prime - phosphorothioate
cccaggagaaggcggagugtt

SEQ ID NO: 961 - DNA, 21 bp, Artificial sequence
  Synthetic sequence: "human only" siRNA
  misc_feature (20)..(20): t is 2prime - deoxy - thymidine - 5prime - phosphorothioate
aacuagacuguaagugccutt

SEQ ID NO: 962 - DNA, 21 bp, Artificial sequence
  Synthetic sequence: "human only" siRNA
  misc_feature (20)..(20): t is 2prime - deoxy - thymidine - 5prime - phosphorothioate
aggcacuuacagucuaguutt

SEQ ID NO: 963 - DNA, 21 bp, Artificial sequence
  Synthetic sequence: "human only" siRNA
  misc_feature (20)..(20): t is 2prime - deoxy - thymidine - 5prime - phosphorothioate
uaugcuccaugucuagccctt

SEQ ID NO: 964 - DNA, 21 bp, Artificial sequence
  Synthetic sequence: "human only" siRNA
  misc_feature (20)..(20): t is 2prime - deoxy - thymidine - 5prime - phosphorothioate
gggcuagacauggagcauatt

SEQ ID NO: 965 - DNA, 21 bp, Artificial sequence
  Synthetic sequence: "human only" siRNA
  misc_feature (20)..(20): t is 2prime - deoxy - thymidine - 5prime - phosphorothioate
cccgauguauggaaacugctt

SEQ ID NO: 966 - DNA, 21 bp, Artificial sequence
  Synthetic sequence: "human only" siRNA
  misc_feature (20)..(20): t is 2prime - deoxy - thymidine - 5prime - phosphorothioate
gcaguuuccauacaucgggtt

SEQ ID NO: 967 - DNA, 21 bp, Artificial sequence
  Synthetic sequence: "human only" siRNA
  misc_feature (20)..(20): t is 2prime - deoxy - thymidine - 5prime - phosphorothioate
guacugcuacuauaagcuctt

SEQ ID NO: 968 - DNA, 21 bp, Artificial sequence
  Synthetic sequence: "human only" siRNA
  misc_feature (20)..(20): t is 2prime - deoxy - thymidine - 5prime - phosphorothioate
gagcuuauaguagcaguactt

SEQ ID NO: 969 - DNA, 21 bp, Artificial sequence
  Synthetic sequence: "human only" siRNA
  misc_feature (20)..(20): t is 2prime - deoxy - thymidine - 5prime - phosphorothioate
agcgugaccagcuaccagctt

SEQ ID NO: 970 - DNA, 21 bp, Artificial sequence
  Synthetic sequence: "human only" siRNA
  misc_feature (20)..(20): t is 2prime - deoxy - thymidine - 5prime - phosphorothioate
gcugguagcuggucacgcutt

SEQ ID NO: 971 - DNA, 21 bp, Artificial sequence
  Synthetic sequence: "human only" siRNA
  misc_feature (20)..(20): t is 2prime - deoxy - thymidine - 5prime - phosphorothioate
acaauuacaccgucaacaatt

SEQ ID NO: 972 - DNA, 21 bp, Artificial sequence
  Synthetic sequence: "human only" siRNA
  misc_feature (20)..(20): t is 2prime - deoxy - thymidine - 5prime - phosphorothioate
uuguugacgguguaauugutt

SEQ ID NO: 973 - DNA, 21 bp, Artificial sequence
  Synthetic sequence: "human only" siRNA
  misc_feature (20)..(20): t is 2prime - deoxy - thymidine - 5prime - phosphorothioate
augcuccucuggugggaggtt

SEQ ID NO: 974 - DNA, 21 bp, Artificial sequence
  Synthetic sequence: "human only" siRNA
  misc_feature (20)..(20): t is 2prime - deoxy - thymidine - 5prime - phosphorothioate
ccucccaccagaggagcautt

SEQ ID NO: 975 - DNA, 21 bp, Artificial sequence
  Synthetic sequence: "human only" siRNA
  misc_feature (20)..(20): t is 2prime - deoxy - thymidine - 5prime - phosphorothioate
aacaguagcugaugaagcutt

SEQ ID NO: 976 - DNA, 21 bp, Artificial sequence
  Synthetic sequence: "human only" siRNA
  misc_feature (20)..(20): t is 2prime - deoxy - thymidine - 5prime - phosphorothioate
agcuucaucagcuacuguutt

SEQ ID NO: 977 - DNA, 21 bp, Artificial sequence
  Synthetic sequence: "human only" siRNA
  misc_feature (20)..(20): t is 2prime - deoxy - thymidine - 5prime - phosphorothioate
cugacucccgagggcuaggtt

SEQ ID NO: 978 - DNA, 21 bp, Artificial sequence
  Synthetic sequence: "human only" siRNA
  misc_feature (20)..(20): t is 2prime - deoxy - thymidine - 5prime - phosphorothioate
ccuagcccucgggagucagtt

SEQ ID NO: 979 - DNA, 21 bp, Artificial sequence
  Synthetic sequence: "human only" siRNA
  misc_feature (20)..(20): t is 2prime - deoxy - thymidine - 5prime - phosphorothioate
gugcaaccagaacaaaucgtt

SEQ ID NO: 980 - DNA, 21 bp, Artificial sequence
  Synthetic sequence: "human only" siRNA
  misc_feature (20)..(20): t is 2prime - deoxy - thymidine - 5prime - phosphorothioate
cgauuuguucugguugcactt

SEQ ID NO: 981 - DNA, 21 bp, Artificial sequence
  Synthetic sequence: "human only" siRNA
  misc_feature (20)..(20): t is 2prime - deoxy - thymidine - 5prime - phosphorothioate
ugcaaccagaacaaaucggtt

SEQ ID NO: 982 - DNA, 21 bp, Artificial sequence
  Synthetic sequence: "human only" siRNA
  misc_feature (20)..(20): t is 2prime - deoxy - thymidine - 5prime - phosphorothioate
ccgauuuguucugguugcatt

SEQ ID NO: 983 - DNA, 21 bp, Artificial sequence
  Synthetic sequence: "human only" siRNA
  misc_feature (20)..(20): t is 2prime - deoxy - thymidine - 5prime - phosphorothioate
cuucaaaguacacacagcatt

SEQ ID NO: 984 - DNA, 21 bp, Artificial sequence
  Synthetic sequence: "human only" siRNA
  misc_feature (20)..(20): t is 2prime - deoxy - thymidine - 5prime - phosphorothioate
ugcuguguguacuuugaagtt

SEQ ID NO: 985 - DNA, 21 bp, Artificial sequence
  Synthetic sequence: "human only" siRNA
  misc_feature (20)..(20): t is 2prime - deoxy - thymidine - 5prime - phosphorothioate
cagcgugaccagcuaccagtt

SEQ ID NO: 986 - DNA, 21 bp, Artificial sequence
  Synthetic sequence: "human only" siRNA
  misc_feature (20)..(20): t is 2prime - deoxy - thymidine - 5prime - phosphorothioate
cugguagcuggucacgcugtt

SEQ ID NO: 987 - DNA, 21 bp, Artificial sequence
  Synthetic sequence: "human only" siRNA
  misc_feature (20)..(20): t is 2prime - deoxy - thymidine - 5prime - phosphorothioate
agaacaauuacaccgucaatt

SEQ ID NO: 988 - DNA, 21 bp, Artificial sequence
  Synthetic sequence: "human only" siRNA
  misc_feature (20)..(20): t is 2prime - deoxy - thymidine - 5prime - phosphorothioate
uugacgguguaauuguucutt

SEQ ID NO: 989 - DNA, 21 bp, Artificial sequence
  Synthetic sequence: "human only" siRNA
  misc_feature (20)..(20): t is 2prime - deoxy - thymidine - 5prime - phosphorothioate
gauaaccaggacaaaacactt

SEQ ID NO: 990 - DNA, 21 bp, Artificial sequence
  Synthetic sequence: "human only" siRNA
  misc_feature (20)..(20): t is 2prime - deoxy - thymidine - 5prime - phosphorothioate
guguuuuguccugguuauctt

SEQ ID NO: 991 - DNA, 21 bp, Artificial sequence
  Synthetic sequence: "human only" siRNA
  misc_feature (20)..(20): t is 2prime - deoxy - thymidine - 5prime - phosphorothioate
acaaccaaggguacacgcatt

SEQ ID NO: 992 - DNA, 21 bp, Artificial sequence
  Synthetic sequence: "human only" siRNA
  misc_feature (20)..(20): t is 2prime - deoxy - thymidine - 5prime - phosphorothioate
ugcguguacccuugguugutt

SEQ ID NO: 993 - DNA, 21 bp, Artificial sequence
  Synthetic sequence: "human only" siRNA
  misc_feature (20)..(20): t is 2prime - deoxy - thymidine - 5prime - phosphorothioate
cccagcgacggcuuaagcctt

SEQ ID NO: 994 - DNA, 21 bp, Artificial sequence
  Synthetic sequence: "human only" siRNA
  misc_feature (20)..(20): t is 2prime - deoxy - thymidine - 5prime - phosphorothioate
ggcuuaagccgucgcugggtt

SEQ ID NO: 995 - DNA, 21 bp, Artificial sequence
  Synthetic sequence: "human only" siRNA
  misc_feature (20)..(20): t is 2prime - deoxy - thymidine - 5prime - phosphorothioate
cucccgagggcuagggcuatt

SEQ ID NO: 996 - DNA, 21 bp, Artificial sequence
  Synthetic sequence: "human only" siRNA
  misc_feature (20)..(20): t is 2prime - deoxy - thymidine - 5prime - phosphorothioate
uagcccuagcccucgggagtt

SEQ ID NO: 997 - DNA, 21 bp, Artificial sequence
  Synthetic sequence: "human only" siRNA
  misc_feature (20)..(20): t is 2prime - deoxy - thymidine - 5prime - phosphorothioate
uagaacccugcucagacactt

SEQ ID NO: 998 - DNA, 21 bp, Artificial sequence
  Synthetic sequence: "human only" siRNA
  misc_feature (20)..(20): t is 2prime - deoxy - thymidine - 5prime - phosphorothioate
gugucugagcaggguucuatt

SEQ ID NO: 999 - DNA, 21 bp, Artificial sequence
  Synthetic sequence: "human only" siRNA
  misc_feature (20)..(20): t is 2prime - deoxy - thymidine - 5prime - phosphorothioate
ccugggcuguuucaccaagtt

SEQ ID NO: 1000 - DNA, 21 bp, Artificial sequence
  Synthetic sequence: "human only" siRNA
  misc_feature (20)..(20): t is 2prime - deoxy - thymidine - 5prime - phosphorothioate
cuuggugaaacagcccaggtt

SEQ ID NO: 1001 - DNA, 21 bp, Artificial sequence
  Synthetic sequence: "human only" siRNA
  misc_feature (20)..(20): t is 2prime - deoxy - thymidine - 5prime - phosphorothioate
ggaucagccaagcgaaacutt

SEQ ID NO: 1002 - DNA, 21 bp, Artificial sequence
  Synthetic sequence: "human only" siRNA
  misc_feature (20)..(20): t is 2prime - deoxy - thymidine - 5prime - phosphorothioate
aguuucgcuuggcugaucctt

SEQ ID NO: 1003 - DNA, 21 bp, Artificial sequence
  Synthetic sequence: "human only" siRNA
  misc_feature (20)..(20): t is 2prime - deoxy - thymidine - 5prime - phosphorothioate
aagaaaccgcugauaaccatt

SEQ ID NO: 1004 - DNA, 21 bp, Artificial sequence
  Synthetic sequence: "human only" siRNA
  misc_feature (20)..(20): t is 2prime - deoxy - thymidine - 5prime - phosphorothioate
ugguuaucagcgguuucuutt

SEQ ID NO: 1005 - DNA, 21 bp, Artificial sequence
  Synthetic sequence: "human only" siRNA
  misc_feature (20)..(20): t is 2prime - deoxy - thymidine - 5prime - phosphorothioate
accaaggguacacgcaggctt

SEQ ID NO: 1006 - DNA, 21 bp, Artificial sequence
  Synthetic sequence: "human only" siRNA
  misc_feature (20)..(20): t is 2prime - deoxy - thymidine - 5prime - phosphorothioate
gccugcguguacccuuggutt

SEQ ID NO: 1007 - DNA, 21 bp, Artificial sequence
  Synthetic sequence: "human only" siRNA
  misc_feature (20)..(20): t is 2prime - deoxy - thymidine - 5prime - phosphorothioate
guagcacagaugucugcuctt

SEQ ID NO: 1008 - DNA, 21 bp, Artificial sequence
  Synthetic sequence: "human only" siRNA
  misc_feature (20)..(20): t is 2prime - deoxy - thymidine - 5prime - phosphorothioate
gagcagacaucugugcuactt

SEQ ID NO: 1009 - DNA, 21 bp, Artificial sequence
  Synthetic sequence: "human only" siRNA
  misc_feature (20)..(20): t is 2prime - deoxy - thymidine - 5prime - phosphorothioate
uuucauaccucuacauguctt

SEQ ID NO: 1010 - DNA, 21 bp, Artificial sequence
  Synthetic sequence: "human only" siRNA
  misc_feature (20)..(20): t is 2prime - deoxy - thymidine - 5prime - phosphorothioate
gacauguagagguaugaaatt

SEQ ID NO: 1011 - DNA, 21 bp, Artificial sequence
  Synthetic sequence: "human only" siRNA
  misc_feature (20)..(20): t is 2prime - deoxy - thymidine - 5prime - phosphorothioate
ccaaccaucugccagagaatt

SEQ ID NO: 1012 - DNA, 21 bp, Artificial sequence
  Synthetic sequence: "human only" siRNA
  misc_feature (20)..(20): t is 2prime - deoxy - thymidine - 5prime - phosphorothioate
uucucuggcagaugguuggtt

SEQ ID NO: 1013 - DNA, 21 bp, Artificial sequence
  Synthetic sequence: "human only" siRNA
  misc_feature (20)..(20): t is 2prime - deoxy - thymidine - 5prime - phosphorothioate
gucagggacugaaucuugctt

SEQ ID NO: 1014 - DNA, 21 bp, Artificial sequence
  Synthetic sequence: "human only" siRNA
  misc_feature (20)..(20): t is 2prime - deoxy - thymidine - 5prime - phosphorothioate
gcaagauucagucccugactt

SEQ ID NO: 1015 - DNA, 21 bp, Artificial sequence
  Synthetic sequence: "human only" siRNA
  misc_feature (20)..(20): t is 2prime - deoxy - thymidine - 5prime - phosphorothioate
agcaugaucaaggagugugtt

SEQ ID NO: 1016 - DNA, 21 bp, Artificial sequence
  Synthetic sequence: "human only" siRNA
  misc_feature (20)..(20): t is 2prime - deoxy - thymidine - 5prime - phosphorothioate
cacacuccuugaucaugcutt

SEQ ID NO: 1017 - DNA, 21 bp, Artificial sequence
  Synthetic sequence: "human only" siRNA
  misc_feature (20)..(20): t is 2prime - deoxy - thymidine - 5prime - phosphorothioate
gcagcgugaccagcuaccatt

SEQ ID NO: 1018 - DNA, 21 bp, Artificial sequence
  Synthetic sequence: "human only" siRNA
  misc_feature (20)..(20): t is 2prime - deoxy - thymidine - 5prime - phosphorothioate
ugguagcuggucacgcugctt

SEQ ID NO: 1019 - DNA, 21 bp, Artificial sequence
  Synthetic sequence: "human only" siRNA
  misc_feature (20)..(20): t is 2prime - deoxy - thymidine - 5prime - phosphorothioate
cagcucucugcugguuacutt

SEQ ID NO: 1020 - DNA, 21 bp, Artificial sequence
  Synthetic sequence: "human only" siRNA
  misc_feature (20)..(20): t is 2prime - deoxy - thymidine - 5prime - phosphorothioate
aguaaccagcagagagcugtt

SEQ ID NO: 1021 - DNA, 21 bp, Artificial sequence
  Synthetic sequence: "human only" siRNA
  misc_feature (20)..(20): t is 2prime - deoxy - thymidine - 5prime - phosphorothioate
guucggcuccucgguguugtt

SEQ ID NO: 1022 - DNA, 21 bp, Artificial sequence
  Synthetic sequence: "human only" siRNA
  misc_feature (20)..(20): t is 2prime - deoxy - thymidine - 5prime - phosphorothioate
caacaccgaggagccgaactt

SEQ ID NO: 1023 - DNA, 21 bp, Artificial sequence
  Synthetic sequence: "human only" siRNA
  misc_feature (20)..(20): t is 2prime - deoxy - thymidine - 5prime - phosphorothioate
gcagaugcuccucugguggtt

SEQ ID NO: 1024 - DNA, 21 bp, Artificial sequence
  Synthetic sequence: "human only" siRNA
  misc_feature (20)..(20): t is 2prime - deoxy - thymidine - 5prime - phosphorothioate
ccaccagaggagcaucugctt

SEQ ID NO: 1025 - DNA, 21 bp, Artificial sequence
  Synthetic sequence: "human only" siRNA
  misc_feature (20)..(20): t is 2prime - deoxy - thymidine - 5prime - phosphorothioate
aggaaguugcuccaagaactt

SEQ ID NO: 1026 - DNA, 21 bp, Artificial sequence
  Synthetic sequence: "human only" siRNA
  misc_feature (20)..(20): t is 2prime - deoxy - thymidine - 5prime - phosphorothioate
guucuuggagcaacuuccutt

SEQ ID NO: 1027 - DNA, 21 bp, Artificial sequence
  Synthetic sequence: "human only" siRNA
  misc_feature (20)..(20): t is 2prime - deoxy - thymidine - 5prime - phosphorothioate
aacgcuucugccacaucuutt

SEQ ID NO: 1028 - DNA, 21 bp, Artificial sequence
  Synthetic sequence: "human only" siRNA
  misc_feature (20)..(20): t is 2prime - deoxy - thymidine - 5prime - phosphorothioate
aagauguggcagaagcguutt

SEQ ID NO: 1029 - DNA, 21 bp, Artificial sequence
  Synthetic sequence: "human only" siRNA
  misc_feature (20)..(20): t is 2prime - deoxy - thymidine - 5prime - phosphorothioate
caccugggcuguuucaccatt

SEQ ID NO: 1030 - DNA, 21 bp, Artificial sequence
  Synthetic sequence: "human only" siRNA
  misc_feature (20)..(20): t is 2prime - deoxy - thymidine - 5prime - phosphorothioate
uggugaaacagcccaggugtt

SEQ ID NO: 1031 - DNA, 21 bp, Artificial sequence
  Synthetic sequence: "human only" siRNA
  misc_feature (20)..(20): t is 2prime - deoxy - thymidine - 5prime - phosphorothioate
aagccaugcagcgugaccatt

SEQ ID NO: 1032 - DNA, 21 bp, Artificial sequence
  Synthetic sequence: "human only" siRNA
  misc_feature (20)..(20): t is 2prime - deoxy - thymidine - 5prime - phosphorothioate
uggucacgcugcauggcuutt

SEQ ID NO: 1033 - DNA, 21 bp, Artificial sequence
  Synthetic sequence: "human only" siRNA
  misc_feature (20)..(20): t is 2prime - deoxy - thymidine - 5prime - phosphorothioate
cgagggcuagggcuagagctt

SEQ ID NO: 1034 - DNA, 21 bp, Artificial sequence
  Synthetic sequence: "human only" siRNA
  misc_feature (20)..(20): t is 2prime - deoxy - thymidine - 5prime - phosphorothioate
gcucuagcccuagcccucgtt

SEQ ID NO: 1035 - DNA, 21 bp, Artificial sequence
  Synthetic sequence: "human only" siRNA
  misc_feature (20)..(20): t is 2prime - deoxy - thymidine - 5prime - phosphorothioate
ggaaacccuggacagacuutt

SEQ ID NO: 1036 - DNA, 21 bp, Artificial sequence
  Synthetic sequence: "human only" siRNA
  misc_feature (20)..(20): t is 2prime - deoxy - thymidine - 5prime - phosphorothioate
aagucuguccaggguuucctt

SEQ ID NO: 1037 - DNA, 21 bp, Artificial sequence
  Synthetic sequence: "human only" siRNA
  misc_feature (20)..(20): t is 2prime - deoxy - thymidine - 5prime - phosphorothioate
guagcugaugaagcugccctt

SEQ ID NO: 1038 - DNA, 21 bp, Artificial sequence
  Synthetic sequence: "human only" siRNA
  misc_feature (20)..(20): t is 2prime - deoxy - thymidine - 5prime - phosphorothioate
gggcagcuucaucagcuactt

SEQ ID NO: 1039 - DNA, 21 bp, Artificial sequence
  Synthetic sequence: "human only" siRNA
  misc_feature (20)..(20): t is 2prime - deoxy - thymidine - 5prime - phosphorothioate
ucuuuuucccuuggaucagtt

SEQ ID NO: 1040 - DNA, 21 bp, Artificial sequence
  Synthetic sequence: "human only" siRNA
  misc_feature (20)..(20): t is 2prime - deoxy - thymidine - 5prime - phosphorothioate
cugauccaagggaaaaagatt

SEQ ID NO: 1041 - DNA, 21 bp, Artificial sequence
  Synthetic sequence: "human only" siRNA
  misc_feature (20)..(20): t is 2prime - deoxy - thymidine - 5prime - phosphorothioate
cuccaguagcacagauguctt

SEQ ID NO: 1042 - DNA, 21 bp, Artificial sequence
  Synthetic sequence: "human only" siRNA
  misc_feature (20)..(20): t is 2prime - deoxy - thymidine - 5prime - phosphorothioate
gacaucugugcuacuggagtt

SEQ ID NO: 1043 - DNA, 21 bp, Artificial sequence
  Synthetic sequence: "human only" siRNA
  misc_feature (20)..(20): t is 2prime - deoxy - thymidine - 5prime - phosphorothioate
ccaaaauugaucacuccgctt

SEQ ID NO: 1044 - DNA, 21 bp, Artificial sequence
  Synthetic sequence: "human only" siRNA
  misc_feature (20)..(20): t is 2prime - deoxy - thymidine - 5prime - phosphorothioate
gcggagugaucaauuuuggtt

SEQ ID NO: 1045 - DNA, 21 bp, Artificial sequence
  Synthetic sequence: "human only" siRNA
  misc_feature (20)..(20): t is 2prime - deoxy - thymidine - 5prime - phosphorothioate
cagaccaccugggcuguuutt

SEQ ID NO: 1046 - DNA, 21 bp, Artificial sequence
  Synthetic sequence: "human only" siRNA
  misc_feature (20)..(20): t is 2prime - deoxy - thymidine - 5prime - phosphorothioate
aaacagcccagguggucugtt

SEQ ID NO: 1047 - DNA, 21 bp, Artificial sequence
  Synthetic sequence: "human only" siRNA
  misc_feature (20)..(20): t is 2prime - deoxy - thymidine - 5prime - phosphorothioate
cccuucccaacuagacugutt

SEQ ID NO: 1048 - DNA, 21 bp, Artificial sequence
  Synthetic sequence: "human only" siRNA
  misc_feature (20)..(20): t is 2prime - deoxy - thymidine - 5prime - phosphorothioate
acagucuaguugggaagggtt

SEQ ID NO: 1049 - DNA, 21 bp, Artificial sequence
  Synthetic sequence: "human only" siRNA
  misc_feature (20)..(20): t is 2prime - deoxy - thymidine - 5prime - phosphorothioate
cgcagccgucgcgaccugctt

SEQ ID NO: 1050 - DNA, 21 bp, Artificial sequence
  Synthetic sequence: "human only" siRNA
  misc_feature (20)..(20): t is 2prime - deoxy - thymidine - 5prime - phosphorothioate
gcaggucgcgacggcugcgtt

SEQ ID NO: 1051 - DNA, 21 bp, Artificial sequence
  Synthetic sequence: "human only" siRNA
  misc_feature (20)..(20): t is 2prime - deoxy - thymidine - 5prime - phosphorothioate
uucucacaccaaggcagautt

SEQ ID NO: 1052 - DNA, 21 bp, Artificial sequence
  Synthetic sequence: "human only" siRNA
  misc_feature (20)..(20): t is 2prime - deoxy - thymidine - 5prime - phosphorothioate
aucugccuuggugugagaatt

SEQ ID NO: 1053 - DNA, 21 bp, Artificial sequence
  Synthetic sequence: "human only" siRNA
  misc_feature (20)..(20): t is 2prime - deoxy - thymidine - 5prime - phosphorothioate
caccaccauccacggcgcctt

SEQ ID NO: 1054 - DNA, 21 bp, Artificial sequence
  Synthetic sequence: "human only" siRNA
  misc_feature (20)..(20): t is 2prime - deoxy - thymidine - 5prime - phosphorothioate
ggcgccguggaugguggugtt

SEQ ID NO: 1055 - DNA, 21 bp, Artificial sequence
  Synthetic sequence: "human only" siRNA
  misc_feature (20)..(20): t is 2prime - deoxy - thymidine - 5prime - phosphorothioate
ccauuacuuuugugaacgctt

SEQ ID NO: 1056 - DNA, 21 bp, Artificial sequence
  Synthetic sequence: "human only" siRNA
  misc_feature (20)..(20): t is 2prime - deoxy - thymidine - 5prime - phosphorothioate
gcguucacaaaaguaauggtt

SEQ ID NO: 1057 - DNA, 21 bp, Artificial sequence
  Synthetic sequence: "human only" siRNA
  misc_feature (20)..(20): t is 2prime - deoxy - thymidine - 5prime - phosphorothioate
ccaagaacaguagcugaugtt

SEQ ID NO: 1058 - DNA, 21 bp, Artificial sequence
  Synthetic sequence: "human only" siRNA
  misc_feature (20)..(20): t is 2prime - deoxy - thymidine - 5prime - phosphorothioate
caucagcuacuguucuuggtt

SEQ ID NO: 1059 - DNA, 21 bp, Artificial sequence
  Synthetic sequence: "human only" siRNA
  misc_feature (20)..(20): t is 2prime - deoxy - thymidine - 5prime - phosphorothioate
aggagagguuucucacacctt

SEQ ID NO: 1060 - DNA, 21 bp, Artificial sequence
  Synthetic sequence: "human only" siRNA
  misc_feature (20)..(20): t is 2prime - deoxy - thymidine - 5prime - phosphorothioate
ggugugagaaaccucuccutt

SEQ ID NO: 1061 - DNA, 21 bp, Artificial sequence
  Synthetic sequence: "human only" siRNA
  misc_feature (20)..(20): t is 2prime - deoxy - thymidine - 5prime - phosphorothioate
aucauccugcuuggagcaatt

SEQ ID NO: 1062 - DNA, 21 bp, Artificial sequence
  Synthetic sequence: "human only" siRNA
  misc_feature (20)..(20): t is 2prime - deoxy - thymidine - 5prime - phosphorothioate
uugcuccaagcaggaugautt

SEQ ID NO: 1063 - DNA, 21 bp, Artificial sequence
  Synthetic sequence: "human only" siRNA
  misc_feature (20)..(20): t is 2prime - deoxy - thymidine - 5prime - phosphorothioate
gcaucacagagcagacgcutt

SEQ ID NO: 1064 - DNA, 21 bp, Artificial sequence
  Synthetic sequence: "human only" siRNA
  misc_feature (20)..(20): t is 2prime - deoxy - thymidine - 5prime - phosphorothioate
agcgucugcucugugaugctt

SEQ ID NO: 1065 - DNA, 21 bp, Artificial sequence
  Synthetic sequence: "human only" siRNA
  misc_feature (20)..(20): t is 2prime - deoxy - thymidine - 5prime - phosphorothioate
aggagguagccuccacccutt

SEQ ID NO: 1066 - DNA, 21 bp, Artificial sequence
  Synthetic sequence: "human only" siRNA
  misc_feature (20)..(20): t is 2prime - deoxy - thymidine - 5prime - phosphorothioate
aggguggaggcuaccuccutt

SEQ ID NO: 1067 - DNA, 21 bp, Artificial sequence
  Synthetic sequence: "human only" siRNA
  misc_feature (20)..(20): t is 2prime - deoxy - thymidine - 5prime - phosphorothioate
acaaccgcaugaagacggctt

SEQ ID NO: 1068 - DNA, 21 bp, Artificial sequence
  Synthetic sequence: "human only" siRNA
  misc_feature (20)..(20): t is 2prime - deoxy - thymidine - 5prime - phosphorothioate
gccgucuucaugcgguugutt

SEQ ID NO: 1069 - DNA, 21 bp, Artificial sequence
  Synthetic sequence: "human only" siRNA
  misc_feature (20)..(20): t is 2prime - deoxy - thymidine - 5prime - phosphorothioate
gcaugaagacggccuucugtt

SEQ ID NO: 1070 - DNA, 21 bp, Artificial sequence
  Synthetic sequence: "human only" siRNA
  misc_feature (20)..(20): t is 2prime - deoxy - thymidine - 5prime - phosphorothioate
cagaaggccgucuucaugctt

SEQ ID NO: 1071 - DNA, 21 bp, Artificial sequence
  Synthetic sequence: "human only" siRNA
  misc_feature (20)..(20): t is 2prime - deoxy - thymidine - 5prime - phosphorothioate
gucacgauggucacccucctt

SEQ ID NO: 1072 - DNA, 21 bp, Artificial sequence
  Synthetic sequence: "human only" siRNA
  misc_feature (20)..(20): t is 2prime - deoxy - thymidine - 5prime - phosphorothioate
ggagggugaccaucgugactt

SEQ ID NO: 1073 - DNA, 21 bp, Artificial sequence
  Synthetic sequence: "human only" siRNA
  misc_feature (20)..(20): t is 2prime - deoxy - thymidine - 5prime - phosphorothioate
cccugcucagacaccauuatt

SEQ ID NO: 1074 - DNA, 21 bp, Artificial sequence
  Synthetic sequence: "human only" siRNA
  misc_feature (20)..(20): t is 2prime - deoxy - thymidine - 5prime - phosphorothioate
uaauggugucugagcagggtt

SEQ ID NO: 1075 - DNA, 21 bp, Artificial sequence
  Synthetic sequence: "human only" siRNA
  misc_feature (20)..(20): t is 2prime - deoxy - thymidine - 5prime - phosphorothioate
ucacgauggucacccuccutt

SEQ ID NO: 1076 - DNA, 21 bp, Artificial sequence
  Synthetic sequence: "human only" siRNA
  misc_feature (20)..(20): t is 2prime - deoxy - thymidine - 5prime - phosphorothioate
aggagggugaccaucgugatt

SEQ ID NO: 1077 - DNA, 21 bp, Artificial sequence
  Synthetic sequence: "human only" siRNA
  misc_feature (20)..(20): t is 2prime - deoxy - thymidine - 5prime - phosphorothioate
ucaaccucaacucggacaatt

SEQ ID NO: 1078 - DNA, 21 bp, Artificial sequence
  Synthetic sequence: "human only" siRNA
  misc_feature (20)..(20): t is 2prime - deoxy - thymidine - 5prime - phosphorothioate
uuguccgaguugagguugatt

SEQ ID NO: 1079 - DNA, 21 bp, Artificial sequence
  Synthetic sequence: "human only" siRNA
  misc_feature (20)..(20): t is 2prime - deoxy - thymidine - 5prime - phosphorothioate
ugaccagcuaccagcucuctt

SEQ ID NO: 1080 - DNA, 21 bp, Artificial sequence
  Synthetic sequence: "human only" siRNA
  misc_feature (20)..(20): t is 2prime - deoxy - thymidine - 5prime - phosphorothioate
gagagcugguagcuggucatt

SEQ ID NO: 1081 - DNA, 21 bp, Artificial sequence
  Synthetic sequence: "human only" siRNA
  misc_feature (20)..(20): t is 2prime - deoxy - thymidine - 5prime - phosphorothioate
gauggcccucggugacauctt

SEQ ID NO: 1082 - DNA, 21 bp, Artificial sequence
  Synthetic sequence: "human only" siRNA
  misc_feature (20)..(20): t is 2prime - deoxy - thymidine - 5prime - phosphorothioate
gaugucaccgagggccauctt

SEQ ID NO: 1083 - DNA, 21 bp, Artificial sequence
  Synthetic sequence: "human only" siRNA
  misc_feature (20)..(20): t is 2prime - deoxy - thymidine - 5prime - phosphorothioate
gcuuugacaaggaacuuuctt

SEQ ID NO: 1084 - DNA, 21 bp, Artificial sequence
  Synthetic sequence: "human only" siRNA
  misc_feature (20)..(20): t is 2prime - deoxy - thymidine - 5prime - phosphorothioate
gaaaguuccuugucaaagctt

SEQ ID NO: 1085 - DNA, 21 bp, Artificial sequence
  Synthetic sequence: "human only" siRNA
  misc_feature (20)..(20): t is 2prime - deoxy - thymidine - 5prime - phosphorothioate
cgauacuggucuccaggcctt

SEQ ID NO: 1086 - DNA, 21 bp, Artificial sequence
  Synthetic sequence: "human only" siRNA
  misc_feature (20)..(20): t is 2prime - deoxy - thymidine - 5prime - phosphorothioate
ggccuggagaccaguaucgtt

SEQ ID NO: 1087 - DNA, 21 bp, Artificial sequence
  Synthetic sequence: "human only" siRNA
  misc_feature (20)..(20): t is 2prime - deoxy - thymidine - 5prime - phosphorothioate
ucuggaugucuuccaugcctt

SEQ ID NO: 1088 - DNA, 21 bp, Artificial sequence
  Synthetic sequence: "human only" siRNA
  misc_feature (20)..(20): t is 2prime - deoxy - thymidine - 5prime - phosphorothioate
ggcauggaagacauccagatt

SEQ ID NO: 1089 - DNA, 21 bp, Artificial sequence
  Synthetic sequence: "human only" siRNA
  misc_feature (20)..(20): t is 2prime - deoxy - thymidine - 5prime - phosphorothioate
caggacccuagaccucugctt

SEQ ID NO: 1090 - DNA, 21 bp, Artificial sequence
  Synthetic sequence: "human only" siRNA
  misc_feature (20)..(20): t is 2prime - deoxy - thymidine - 5prime - phosphorothioate
gcagaggucuaggguccugtt

SEQ ID NO: 1091 - DNA, 21 bp, Artificial sequence
  Synthetic sequence: "human only" siRNA
  misc_feature (20)..(20): t is 2prime - deoxy - thymidine - 5prime - phosphorothioate
gacccuagaccucugcagctt

SEQ ID NO: 1092 - DNA, 21 bp, Artificial sequence
  Synthetic sequence: "human only" siRNA
  misc_feature (20)..(20): t is 2prime - deoxy - thymidine - 5prime - phosphorothioate
gcugcagaggucuaggguctt

SEQ ID NO: 1093 - DNA, 21 bp, Artificial sequence
  Synthetic sequence: "human only" siRNA
  misc_feature (20)..(20): t is 2prime - deoxy - thymidine - 5prime - phosphorothioate
acccuagaccucugcagcctt

SEQ ID NO: 1094 - DNA, 21 bp, Artificial sequence
  Synthetic sequence: "human only" siRNA
  misc_feature (20)..(20): t is 2prime - deoxy - thymidine - 5prime - phosphorothioate
ggcugcagaggucuagggutt

SEQ ID NO: 1095 - DNA, 21 bp, Artificial sequence
  Synthetic sequence: "human only" siRNA
  misc_feature (20)..(20): t is 2prime - deoxy - thymidine - 5prime - phosphorothioate
cagcccacggcggaggaggtt

SEQ ID NO: 1096 - DNA, 21 bp, Artificial sequence
  Synthetic sequence: "human only" siRNA
  misc_feature (20)..(20): t is 2prime - deoxy - thymidine - 5prime - phosphorothioate
ccuccuccgccgugggcugtt

SEQ ID NO: 1097 - DNA, 21 bp, Artificial sequence
  Synthetic sequence: "human only" siRNA
  misc_feature (20)..(20): t is 2prime - deoxy - thymidine - 5prime - phosphorothioate
cucuucgaguucuucugcatt

SEQ ID NO: 1098 - DNA, 21 bp, Artificial sequence
  Synthetic sequence: "human only" siRNA
  misc_feature (20)..(20): t is 2prime - deoxy - thymidine - 5prime - phosphorothioate
ugcagaagaacucgaagagtt

SEQ ID NO: 1099 - DNA, 21 bp, Artificial sequence
  Synthetic sequence: "human only" siRNA
  misc_feature (20)..(20): t is 2prime - deoxy - thymidine - 5prime - phosphorothioate
uuggcaugauguacuggcatt

SEQ ID NO: 1100 - DNA, 21 bp, Artificial sequence
  Synthetic sequence: "human only" siRNA
  misc_feature (20)..(20): t is 2prime - deoxy - thymidine - 5prime - phosphorothioate
ugccaguacaucaugccaatt

SEQ ID NO: 1101 - DNA, 21 bp, Artificial sequence
  Synthetic sequence: "human only" siRNA
  misc_feature (20)..(20): t is 2prime - deoxy - thymidine - 5prime - phosphorothioate
ggcaugauguacuggcaautt

SEQ ID NO: 1102 - DNA, 21 bp, Artificial sequence
  Synthetic sequence: "human only" siRNA
  misc_feature (20)..(20): t is 2prime - deoxy - thymidine - 5prime - phosphorothioate
auugccaguacaucaugcctt

SEQ ID NO: 1103 - DNA, 21 bp, Artificial sequence
  Synthetic sequence: "human only" siRNA
  misc_feature (20)..(20): t is 2prime - deoxy - thymidine - 5prime - phosphorothioate
uguacuggcaauucggccutt

SEQ ID NO: 1104 - DNA, 21 bp, Artificial sequence
  Synthetic sequence: "human only" siRNA
  misc_feature (20)..(20): t is 2prime - deoxy - thymidine - 5prime - phosphorothioate
aggccgaauugccaguacatt

SEQ ID NO: 1105 - DNA, 21 bp, Artificial sequence
  Synthetic sequence: "human only" siRNA
  misc_feature (20)..(20): t is 2prime - deoxy - thymidine - 5prime - phosphorothioate
acuggcaauucggccugcutt

SEQ ID NO: 1106 - DNA, 21 bp, Artificial sequence
  Synthetic sequence: "human only" siRNA
  misc_feature (20)..(20): t is 2prime - deoxy - thymidine - 5prime - phosphorothioate
agcaggccgaauugccagutt

SEQ ID NO: 1107 - DNA, 21 bp, Artificial sequence
  Synthetic sequence: "human only" siRNA
  misc_feature (20)..(20): t is 2prime - deoxy - thymidine - 5prime - phosphorothioate
ggcaauucggccugcuuuutt

SEQ ID NO: 1108 - DNA, 21 bp, Artificial sequence
  Synthetic sequence: "human only" siRNA
  misc_feature (20)..(20): t is 2prime - deoxy - thymidine - 5prime - phosphorothioate
aaaagcaggccgaauugcctt

SEQ ID NO: 1109 - DNA, 21 bp, Artificial sequence
  Synthetic sequence: "human only" siRNA
  misc_feature (20)..(20): t is 2prime - deoxy - thymidine - 5prime - phosphorothioate
caauucggccugcuuuucgtt

SEQ ID NO: 1110 - DNA, 21 bp, Artificial sequence
  Synthetic sequence: "human only" siRNA
  misc_feature (20)..(20): t is 2prime - deoxy - thymidine - 5prime - phosphorothioate
cgaaaagcaggccgaauugtt

SEQ ID NO: 1111 - DNA, 21 bp, Artificial sequence
  Synthetic sequence: "human only" siRNA
  misc_feature (20)..(20): t is 2prime - deoxy - thymidine - 5prime - phosphorothioate
ucggagaguacuucagcuatt

SEQ ID NO: 1112 - DNA, 21 bp, Artificial sequence
  Synthetic sequence: "human only" siRNA
  misc_feature (20)..(20): t is 2prime - deoxy - thymidine - 5prime - phosphorothioate
uagcugaaguacucuccgatt

SEQ ID NO: 1113 - DNA, 21 bp, Artificial sequence
  Synthetic sequence: "human only" siRNA
  misc_feature (20)..(20): t is 2prime - deoxy - thymidine - 5prime - phosphorothioate
caacauccugucgaggcugtt

SEQ ID NO: 1114 - DNA, 21 bp, Artificial sequence
  Synthetic sequence: "human only" siRNA
  misc_feature (20)..(20): t is 2prime - deoxy - thymidine - 5prime - phosphorothioate
cagccucgacaggauguugtt

SEQ ID NO: 1115 - DNA, 21 bp, Artificial sequence
  Synthetic sequence: "human only" siRNA
  misc_feature (20)..(20): t is 2prime - deoxy - thymidine - 5prime - phosphorothioate
cauccugucgaggcugccatt

SEQ ID NO: 1116 - DNA, 21 bp, Artificial sequence
  Synthetic sequence: "human only" siRNA
  misc_feature (20)..(20): t is 2prime - deoxy - thymidine - 5prime - phosphorothioate
uggcagccucgacaggaugtt

SEQ ID NO: 1117 - DNA, 21 bp, Artificial sequence
  Synthetic sequence: "human only" siRNA
  misc_feature (20)..(20): t is 2prime - deoxy - thymidine - 5prime - phosphorothioate
uccugcaaccaggcgaauutt

SEQ ID NO: 1118 - DNA, 21 bp, Artificial sequence
  Synthetic sequence: "human only" siRNA
  misc_feature (20)..(20): t is 2prime - deoxy - thymidine - 5prime - phosphorothioate
aauucgccugguugcaggatt

SEQ ID NO: 1119 - DNA, 21 bp, Artificial sequence
  Synthetic sequence: "human only" siRNA
  misc_feature (20)..(20): t is 2prime - deoxy - thymidine - 5prime - phosphorothioate
ggaaacugcuauacuuucatt

SEQ ID NO: 1120 - DNA, 21 bp, Artificial sequence
  Synthetic sequence: "human only" siRNA
  misc_feature (20)..(20): t is 2prime - deoxy - thymidine - 5prime - phosphorothioate
ugaaaguauagcaguuucctt

SEQ ID NO: 1121 - DNA, 21 bp, Artificial sequence
  Synthetic sequence: "human only" siRNA
  misc_feature (20)..(20): t is 2prime - deoxy - thymidine - 5prime - phosphorothioate
acggucugucccugaugcutt

SEQ ID NO: 1122 - DNA, 21 bp, Artificial sequence
  Synthetic sequence: "human only" siRNA
  misc_feature (20)..(20): t is 2prime - deoxy - thymidine - 5prime - phosphorothioate
agcaucagggacagaccgutt

SEQ ID NO: 1123 - DNA, 21 bp, Artificial sequence
  Synthetic sequence: "human only" siRNA
  misc_feature (20)..(20): t is 2prime - deoxy - thymidine - 5prime - phosphorothioate
ggucugucccugaugcugctt

SEQ ID NO: 1124 - DNA, 21 bp, Artificial sequence
  Synthetic sequence: "human only" siRNA
  misc_feature (20)..(20): t is 2prime - deoxy - thymidine - 5prime - phosphorothioate
gcagcaucagggacagacctt

SEQ ID NO: 1125 - DNA, 21 bp, Artificial sequence
  Synthetic sequence: "human only" siRNA
  misc_feature (20)..(20): t is 2prime - deoxy - thymidine - 5prime - phosphorothioate
ggcccggguaauggugcactt

SEQ ID NO: 1126 - DNA, 21 bp, Artificial sequence
  Synthetic sequence: "human only" siRNA
  misc_feature (20)..(20): t is 2prime - deoxy - thymidine - 5prime - phosphorothioate
gugcaccauuacccgggcctt

SEQ ID NO: 1127 - DNA, 21 bp, Artificial sequence
  Synthetic sequence: "human only" siRNA
  misc_feature (20)..(20): t is 2prime - deoxy - thymidine - 5prime - phosphorothioate
caggaugaaccugccuuuatt

SEQ ID NO: 1128 - DNA, 21 bp, Artificial sequence
  Synthetic sequence: "human only" siRNA
  misc_feature (20)..(20): t is 2prime - deoxy - thymidine - 5prime - phosphorothioate
uaaaggcagguucauccugtt

SEQ ID NO: 1129 - DNA, 21 bp, Artificial sequence
  Synthetic sequence: "human only" siRNA
  misc_feature (20)..(20): t is 2prime - deoxy - thymidine - 5prime - phosphorothioate
gaugaaccugccuuuauggtt

SEQ ID NO: 1130 - DNA, 21 bp, Artificial sequence
  Synthetic sequence: "human only" siRNA
  misc_feature (20)..(20): t is 2prime - deoxy - thymidine - 5prime - phosphorothioate
ccauaaaggcagguucauctt

SEQ ID NO: 1131 - DNA, 21 bp, Artificial sequence
  Synthetic sequence: "human only" siRNA
  misc_feature (20)..(20): t is 2prime - deoxy - thymidine - 5prime - phosphorothioate
gguggcuuuaacuugcggctt

SEQ ID NO: 1132 - DNA, 21 bp, Artificial sequence
  Synthetic sequence: "human only" siRNA
  misc_feature (20)..(20): t is 2prime - deoxy - thymidine - 5prime - phosphorothioate
gccgcaaguuaaagccacctt

SEQ ID NO: 1133 - DNA, 21 bp, Artificial sequence
  Synthetic sequence: "human only" siRNA
  misc_feature (20)..(20): t is 2prime - deoxy - thymidine - 5prime - phosphorothioate
guggcuuuaacuugcggcctt

SEQ ID NO: 1134 - DNA, 21 bp, Artificial sequence
  Synthetic sequence: "human only" siRNA
  misc_feature (20)..(20): t is 2prime - deoxy - thymidine - 5prime - phosphorothioate
ggccgcaaguuaaagccactt

SEQ ID NO: 1135 - DNA, 21 bp, Artificial sequence
  Synthetic sequence: "human only" siRNA
  misc_feature (20)..(20): t is 2prime - deoxy - thymidine - 5prime - phosphorothioate
uugcggccuggcguggagatt

SEQ ID NO: 1136 - DNA, 21 bp, Artificial sequence
  Synthetic sequence: "human only" siRNA
  misc_feature (20)..(20): t is 2prime - deoxy - thymidine - 5prime - phosphorothioate
ucuccacgccaggccgcaatt

SEQ ID NO: 1137 - DNA, 21 bp, Artificial sequence
  Synthetic sequence: "human only" siRNA
  misc_feature (20)..(20): t is 2prime - deoxy - thymidine - 5prime - phosphorothioate
ugcggccuggcguggagactt

SEQ ID NO: 1138 - DNA, 21 bp, Artificial sequence
  Synthetic sequence: "human only" siRNA
  misc_feature (20)..(20): t is 2prime - deoxy - thymidine - 5prime - phosphorothioate
gucuccacgccaggccgcatt

SEQ ID NO: 1139 - DNA, 21 bp, Artificial sequence
  Synthetic sequence: "human only" siRNA
  misc_feature (20)..(20): t is 2prime - deoxy - thymidine - 5prime - phosphorothioate
gcggccuggcguggagacctt

SEQ ID NO: 1140 - DNA, 21 bp, Artificial sequence
  Synthetic sequence: "human only" siRNA
  misc_feature (20)..(20): t is 2prime - deoxy - thymidine - 5prime - phosphorothioate
ggucuccacgccaggccgctt

SEQ ID NO: 1141 - DNA, 21 bp, Artificial sequence
  Synthetic sequence: "human only" siRNA
  misc_feature (20)..(20): t is 2prime - deoxy - thymidine - 5prime - phosphorothioate
cagguguguauucacuccutt

SEQ ID NO: 1142 - DNA, 21 bp, Artificial sequence
  Synthetic sequence: "human only" siRNA
  misc_feature (20)..(20): t is 2prime - deoxy - thymidine - 5prime - phosphorothioate
aggagugaauacacaccugtt

SEQ ID NO: 1143 - DNA, 21 bp, Artificial sequence
  Synthetic sequence: "human only" siRNA
  misc_feature (20)..(20): t is 2prime - deoxy - thymidine - 5prime - phosphorothioate
guguauucacuccugcuuctt

SEQ ID NO: 1144 - DNA, 21 bp, Artificial sequence
  Synthetic sequence: "human only" siRNA
  misc_feature (20)..(20): t is 2prime - deoxy - thymidine - 5prime - phosphorothioate
gaagcaggagugaauacactt

SEQ ID NO: 1145 - DNA, 21 bp, Artificial sequence
  Synthetic sequence: "human only" siRNA
  misc_feature (20)..(20): t is 2prime - deoxy - thymidine - 5prime - phosphorothioate
ggcccucggugacaucccatt

SEQ ID NO: 1146 - DNA, 21 bp, Artificial sequence
  Synthetic sequence: "human only" siRNA
  misc_feature (20)..(20): t is 2prime - deoxy - thymidine - 5prime - phosphorothioate
ugggaugucaccgagggcctt

SEQ ID NO: 1147 - DNA, 21 bp, Artificial sequence
  Synthetic sequence: "human only" siRNA
  misc_feature (20)..(20): t is 2prime - deoxy - thymidine - 5prime - phosphorothioate
gaugcuaucgcgacagaactt

SEQ ID NO: 1148 - DNA, 21 bp, Artificial sequence
  Synthetic sequence: "human only" siRNA
  misc_feature (20)..(20): t is 2prime - deoxy - thymidine - 5prime - phosphorothioate
guucugucgcgauagcauctt

SEQ ID NO: 1149 - DNA, 21 bp, Artificial sequence
  Synthetic sequence: "human only" siRNA
  misc_feature (20)..(20): t is 2prime - deoxy - thymidine - 5prime - phosphorothioate
acuacaaaaccaauucugatt

SEQ ID NO: 1150 - DNA, 21 bp, Artificial sequence
  Synthetic sequence: "human only" siRNA
  misc_feature (20)..(20): t is 2prime - deoxy - thymidine - 5prime - phosphorothioate
ucagaauugguuuuguagutt

SEQ ID NO: 1151 - DNA, 21 bp, Artificial sequence
  Synthetic sequence: "human only" siRNA
  misc_feature (20)..(20): t is 2prime - deoxy - thymidine - 5prime - phosphorothioate
caauucugagucucccucutt

SEQ ID NO: 1152 - DNA, 21 bp, Artificial sequence
  Synthetic sequence: "human only" siRNA
  misc_feature (20)..(20): t is 2prime - deoxy - thymidine - 5prime - phosphorothioate
agagggagacucagaauugtt

SEQ ID NO: 1153 - DNA, 21 bp, Artificial sequence
  Synthetic sequence: "human only" siRNA
  misc_feature (20)..(20): t is 2prime - deoxy - thymidine - 5prime - phosphorothioate
cucugucacgauggucacctt

SEQ ID NO: 1154 - DNA, 21 bp, Artificial sequence
  Synthetic sequence: "human only" siRNA
  misc_feature (20)..(20): t is 2prime - deoxy - thymidine - 5prime - phosphorothioate
ggugaccaucgugacagagtt

SEQ ID NO: 1155 - DNA, 21 bp, Artificial sequence
  Synthetic sequence: "human only" siRNA
  misc_feature (20)..(20): t is 2prime - deoxy - thymidine - 5prime - phosphorothioate
cugcuccgaagguuccgaatt

SEQ ID NO: 1156 - DNA, 21 bp, Artificial sequence
  Synthetic sequence: "human only" siRNA
  misc_feature (20)..(20): t is 2prime - deoxy - thymidine - 5prime - phosphorothioate
uucggaaccuucggagcagtt

SEQ ID NO: 1157 - DNA, 21 bp, Artificial sequence
  Synthetic sequence: "human only" siRNA
  misc_feature (20)..(20): t is 2prime - deoxy - thymidine - 5prime - phosphorothioate
agguuccgaagccgauacutt

SEQ ID NO: 1158 - DNA, 21 bp, Artificial sequence
  Synthetic sequence: "human only" siRNA
  misc_feature (20)..(20): t is 2prime - deoxy - thymidine - 5prime - phosphorothioate
aguaucggcuucggaaccutt

SEQ ID NO: 1159 - DNA, 21 bp, Artificial sequence
  Synthetic sequence: "human only" siRNA
  misc_feature (20)..(20): t is 2prime - deoxy - thymidine - 5prime - phosphorothioate
guuccgaagccgauacuggtt

SEQ ID NO: 1160 - DNA, 21 bp, Artificial sequence
  Synthetic sequence: "human only" siRNA
  misc_feature (20)..(20): t is 2prime - deoxy - thymidine - 5prime - phosphorothioate
ccaguaucggcuucggaactt

SEQ ID NO: 1161 - DNA, 21 bp, Artificial sequence
  Synthetic sequence: "human only" siRNA
  misc_feature (20)..(20): t is 2prime - deoxy - thymidine - 5prime - phosphorothioate
cgaagccgauacuggucuctt

SEQ ID NO: 1162 - DNA, 21 bp, Artificial sequence
  Synthetic sequence: "human only" siRNA
  misc_feature (20)..(20): t is 2prime - deoxy - thymidine - 5prime - phosphorothioate
gagaccaguaucggcuucgtt

SEQ ID NO: 1163 - DNA, 21 bp, Artificial sequence
  Synthetic sequence: "human only" siRNA
  misc_feature (20)..(20): t is 2prime - deoxy - thymidine - 5prime - phosphorothioate
aagauugaaggaugugcagtt

SEQ ID NO: 1164 - DNA, 21 bp, Artificial sequence
  Synthetic sequence: "human only" siRNA
  misc_feature (20)..(20): t is 2prime - deoxy - thymidine - 5prime - phosphorothioate
cugcacauccuucaaucuutt

SEQ ID NO: 1165 - DNA, 21 bp, Artificial sequence
  Synthetic sequence: "human only" siRNA
  misc_feature (20)..(20): t is 2prime - deoxy - thymidine - 5prime - phosphorothioate
gauugaaggaugugcagggtt

SEQ ID NO: 1166 - DNA, 21 bp, Artificial sequence
  Synthetic sequence: "human only" siRNA
  misc_feature (20)..(20): t is 2prime - deoxy - thymidine - 5prime - phosphorothioate
cccugcacauccuucaauctt

SEQ ID NO: 1167 - DNA, 21 bp, Artificial sequence
  Synthetic sequence: "human only" siRNA
  misc_feature (20)..(20): t is 2prime - deoxy - thymidine - 5prime - phosphorothioate
ugccucugaacacucuggutt

SEQ ID NO: 1168 - DNA, 21 bp, Artificial sequence
  Synthetic sequence: "human only" siRNA
  misc_feature (20)..(20): t is 2prime - deoxy - thymidine - 5prime - phosphorothioate
accagaguguucagaggcatt

SEQ ID NO: 1169 - DNA, 21 bp, Artificial sequence
  Synthetic sequence: "human only" siRNA
  misc_feature (20)..(20): t is 2prime - deoxy - thymidine - 5prime - phosphorothioate
ccucugaacacucugguuutt

SEQ ID NO: 1170 - DNA, 21 bp, Artificial sequence
  Synthetic sequence: "human only" siRNA
  misc_feature (20)..(20): t is 2prime - deoxy - thymidine - 5prime - phosphorothioate
aaaccagaguguucagaggtt

SEQ ID NO: 1171 - DNA, 21 bp, Artificial sequence
  Synthetic sequence: "human only" siRNA
  misc_feature (20)..(20): t is 2prime - deoxy - thymidine - 5prime - phosphorothioate
gacaaggaacuuuccuaagtt

SEQ ID NO: 1172 - DNA, 21 bp, Artificial sequence
  Synthetic sequence: "human only" siRNA
  misc_feature (20)..(20): t is 2prime - deoxy - thymidine - 5prime - phosphorothioate
cuuaggaaaguuccuuguctt

SEQ ID NO: 1173 - DNA, 21 bp, Artificial sequence
  Synthetic sequence: "human only" siRNA
  misc_feature (20)..(20): t is 2prime - deoxy - thymidine - 5prime - phosphorothioate
caggacaaaacacaaccaatt

SEQ ID NO: 1174 - DNA, 21 bp, Artificial sequence
  Synthetic sequence: "human only" siRNA
  misc_feature (20)..(20): t is 2prime - deoxy - thymidine - 5prime - phosphorothioate
uugguuguguuuuguccugtt

SEQ ID NO: 1175 - DNA, 21 bp, Artificial sequence
  Synthetic sequence: "human only" siRNA
  misc_feature (20)..(20): t is 2prime - deoxy - thymidine - 5prime - phosphorothioate
aacacaaccaaggguacactt

SEQ ID NO: 1176 - DNA, 21 bp, Artificial sequence
  Synthetic sequence: "human only" siRNA
  misc_feature (20)..(20): t is 2prime - deoxy - thymidine - 5prime - phosphorothioate
guguacccuugguuguguutt

SEQ ID NO: 1177 - DNA, 21 bp, Artificial sequence
  Synthetic sequence: "human only" siRNA
  misc_feature (20)..(20): t is 2prime - deoxy - thymidine - 5prime - phosphorothioate
uugaacuugggugggaaactt

SEQ ID NO: 1178 - DNA, 21 bp, Artificial sequence
  Synthetic sequence: "human only" siRNA
  misc_feature (20)..(20): t is 2prime - deoxy - thymidine - 5prime - phosphorothioate
guuucccacccaaguucaatt

SEQ ID NO: 1179 - DNA, 21 bp, Artificial sequence
  Synthetic sequence: "human only" siRNA
  misc_feature (20)..(20): t is 2prime - deoxy - thymidine - 5prime - phosphorothioate
ugaacuugggugggaaacctt

SEQ ID NO: 1180 - DNA, 21 bp, Artificial sequence
  Synthetic sequence: "human only" siRNA
  misc_feature (20)..(20): t is 2prime - deoxy - thymidine - 5prime - phosphorothioate
gguuucccacccaaguucatt

SEQ ID NO: 1181 - DNA, 21 bp, Artificial sequence
  Synthetic sequence: "human only" siRNA
  misc_feature (20)..(20): t is 2prime - deoxy - thymidine - 5prime - phosphorothioate
acccgugcccucacagagctt

SEQ ID NO: 1182 - DNA, 21 bp, Artificial sequence
  Synthetic sequence: "human only" siRNA
  misc_feature (20)..(20): t is 2prime - deoxy - thymidine - 5prime - phosphorothioate
gcucugugagggcacgggutt

SEQ ID NO: 1183 - DNA, 21 bp, Artificial sequence
  Synthetic sequence: "human only" siRNA
  misc_feature (20)..(20): t is 2prime - deoxy - thymidine - 5prime - phosphorothioate
acuauaacaucugcuggagtt

SEQ ID NO: 1184 - DNA, 21 bp, Artificial sequence
  Synthetic sequence: "human only" siRNA
  misc_feature (20)..(20): t is 2prime - deoxy - thymidine - 5prime - phosphorothioate
cuccagcagauguuauagutt

SEQ ID NO: 1185 - DNA, 21 bp, Artificial sequence
  Synthetic sequence: "human only" siRNA
  misc_feature (20)..(20): t is 2prime - deoxy - thymidine - 5prime - phosphorothioate
aucugcuggaguguugcugtt

SEQ ID NO: 1186 - DNA, 21 bp, Artificial sequence
  Synthetic sequence: "human only" siRNA
  misc_feature (20)..(20): t is 2prime - deoxy - thymidine - 5prime - phosphorothioate
cagcaacacuccagcagautt

SEQ ID NO: 1187 - DNA, 21 bp, Artificial sequence
  Synthetic sequence: "human only" siRNA
  misc_feature (20)..(20): t is 2prime - deoxy - thymidine - 5prime - phosphorothioate
cugcuggaguguugcuguutt

SEQ ID NO: 1188 - DNA, 21 bp, Artificial sequence
  Synthetic sequence: "human only" siRNA
  misc_feature (20)..(20): t is 2prime - deoxy - thymidine - 5prime - phosphorothioate
aacagcaacacuccagcagtt

SEQ ID NO: 1189 - DNA, 21 bp, Artificial sequence
  Synthetic sequence: "human only" siRNA
  misc_feature (20)..(20): t is 2prime - deoxy - thymidine - 5prime - phosphorothioate
cuagcccaucauccugcuutt

SEQ ID NO: 1190 - DNA, 21 bp, Artificial sequence
  Synthetic sequence: "human only" siRNA
  misc_feature (20)..(20): t is 2prime - deoxy - thymidine - 5prime - phosphorothioate
aagcaggaugaugggcuagtt

SEQ ID NO: 1191 - DNA, 21 bp, Artificial sequence
  Synthetic sequence: "human only" siRNA
  misc_feature (20)..(20): t is 2prime - deoxy - thymidine - 5prime - phosphorothioate
cucuggaugucuuccaugctt

SEQ ID NO: 1192 - DNA, 21 bp, Artificial sequence
  Synthetic sequence: "human only" siRNA
  misc_feature (20)..(20): t is 2prime - deoxy - thymidine - 5prime - phosphorothioate
gcauggaagacauccagagtt

SEQ ID NO: 1193 - DNA, 21 bp, Artificial sequence
  Synthetic sequence: "human only" siRNA
  misc_feature (20)..(20): t is 2prime - deoxy - thymidine - 5prime - phosphorothioate
agcaggacccuagaccucutt

SEQ ID NO: 1194 - DNA, 21 bp, Artificial sequence
  Synthetic sequence: "human only" siRNA
  misc_feature (20)..(20): t is 2prime - deoxy - thymidine - 5prime - phosphorothioate
agaggucuaggguccugcutt

SEQ ID NO: 1195 - DNA, 21 bp, Artificial sequence
  Synthetic sequence: "human only" siRNA
  misc_feature (20)..(20): t is 2prime - deoxy - thymidine - 5prime - phosphorothioate
uucgaguucuucugcaacatt

SEQ ID NO: 1196 - DNA, 21 bp, Artificial sequence
  Synthetic sequence: "human only" siRNA
  misc_feature (20)..(20): t is 2prime - deoxy - thymidine - 5prime - phosphorothioate
uguugcagaagaacucgaatt

SEQ ID NO: 1197 - DNA, 21 bp, Artificial sequence
  Synthetic sequence: "human only" siRNA
  misc_feature (20)..(20): t is 2prime - deoxy - thymidine - 5prime - phosphorothioate
caccauccacggcgccauctt

SEQ ID NO: 1198 - DNA, 21 bp, Artificial sequence
  Synthetic sequence: "human only" siRNA
  misc_feature (20)..(20): t is 2prime - deoxy - thymidine - 5prime - phosphorothioate
gauggcgccguggauggugtt

SEQ ID NO: 1199 - DNA, 21 bp, Artificial sequence
  Synthetic sequence: "human only" siRNA
  misc_feature (20)..(20): t is 2prime - deoxy - thymidine - 5prime - phosphorothioate
ccacggcgccauccgccugtt

SEQ ID NO: 1200 - DNA, 21 bp, Artificial sequence
  Synthetic sequence: "human only" siRNA
  misc_feature (20)..(20): t is 2prime - deoxy - thymidine - 5prime - phosphorothioate
caggcggauggcgccguggtt

SEQ ID NO: 1201 - DNA, 21 bp, Artificial sequence
  Synthetic sequence: "human only" siRNA
  misc_feature (20)..(20): t is 2prime - deoxy - thymidine - 5prime - phosphorothioate
cagcacaaccgcaugaagatt

SEQ ID NO: 1202 - DNA, 21 bp, Artificial sequence
  Synthetic sequence: "human only" siRNA
  misc_feature (20)..(20): t is 2prime - deoxy - thymidine - 5prime - phosphorothioate
ucuucaugcgguugugcugtt

SEQ ID NO: 1203 - DNA, 21 bp, Artificial sequence
  Synthetic sequence: "human only" siRNA
  misc_feature (20)..(20): t is 2prime - deoxy - thymidine - 5prime - phosphorothioate
ccuuuggcaugauguacugtt

SEQ ID NO: 1204 - DNA, 21 bp, Artificial sequence
  Synthetic sequence: "human only" siRNA
  misc_feature (20)..(20): t is 2prime - deoxy - thymidine - 5prime - phosphorothioate
caguacaucaugccaaaggtt

SEQ ID NO: 1205 - DNA, 21 bp, Artificial sequence
  Synthetic sequence: "human only" siRNA
  misc_feature (20)..(20): t is 2prime - deoxy - thymidine - 5prime - phosphorothioate
auccugucgaggcugccagtt

SEQ ID NO: 1206 - DNA, 21 bp, Artificial sequence
  Synthetic sequence: "human only" siRNA
  misc_feature (20)..(20): t is 2prime - deoxy - thymidine - 5prime - phosphorothioate
cuggcagccucgacaggautt

SEQ ID NO: 1207 - DNA, 21 bp, Artificial sequence
  Synthetic sequence: "human only" siRNA
  misc_feature (20)..(20): t is 2prime - deoxy - thymidine - 5prime - phosphorothioate
ucuccugcaaccaggcgaatt

SEQ ID NO: 1208 - DNA, 21 bp, Artificial sequence
  Synthetic sequence: "human only" siRNA
  misc_feature (20)..(20): t is 2prime - deoxy - thymidine - 5prime - phosphorothioate
uucgccugguugcaggagatt

SEQ ID NO: 1209 - DNA, 21 bp, Artificial sequence
  Synthetic sequence: "human only" siRNA
  misc_feature (20)..(20): t is 2prime - deoxy - thymidine - 5prime - phosphorothioate
ugcaaccaggcgaauuacutt

SEQ ID NO: 1210 - DNA, 21 bp, Artificial sequence
  Synthetic sequence: "human only" siRNA
  misc_feature (20)..(20): t is 2prime - deoxy - thymidine - 5prime - phosphorothioate
aguaauucgccugguugcatt

SEQ ID NO: 1211 - DNA, 21 bp, Artificial sequence
  Synthetic sequence: "human only" siRNA
  misc_feature (20)..(20): t is 2prime - deoxy - thymidine - 5prime - phosphorothioate
accuccaucagcaugaggatt

SEQ ID NO: 1212 - DNA, 21 bp, Artificial sequence
  Synthetic sequence: "human only" siRNA
  misc_feature (20)..(20): t is 2prime - deoxy - thymidine - 5prime - phosphorothioate
uccucaugcugauggaggutt

SEQ ID NO: 1213 - DNA, 21 bp, Artificial sequence
  Synthetic sequence: "human only" siRNA
  misc_feature (20)..(20): t is 2prime - deoxy - thymidine - 5prime - phosphorothioate
gcgacugcaccaagaauggtt

SEQ ID NO: 1214 - DNA, 21 bp, Artificial sequence
  Synthetic sequence: "human only" siRNA
  misc_feature (20)..(20): t is 2prime - deoxy - thymidine - 5prime - phosphorothioate
ccauucuuggugcagucgctt

SEQ ID NO: 1215 - DNA, 21 bp, Artificial sequence
  Synthetic sequence: "human only" siRNA
  misc_feature (20)..(20): t is 2prime - deoxy - thymidine - 5prime - phosphorothioate
accaagaauggcagugaugtt

SEQ ID NO: 1216 - DNA, 21 bp, Artificial sequence
  Synthetic sequence: "human only" siRNA
  misc_feature (20)..(20): t is 2prime - deoxy - thymidine - 5prime - phosphorothioate
caucacugccauucuuggutt

SEQ ID NO: 1217 - DNA, 21 bp, Artificial sequence
  Synthetic sequence: "human only" siRNA
  misc_feature (20)..(20): t is 2prime - deoxy - thymidine - 5prime - phosphorothioate
ugguuacucacgauggccctt

SEQ ID NO: 1218 - DNA, 21 bp, Artificial sequence
  Synthetic sequence: "human only" siRNA
  misc_feature (20)..(20): t is 2prime - deoxy - thymidine - 5prime - phosphorothioate
gggccaucgugaguaaccatt

SEQ ID NO: 1219 - DNA, 21 bp, Artificial sequence
  Synthetic sequence: "human only" siRNA
  misc_feature (20)..(20): t is 2prime - deoxy - thymidine - 5prime - phosphorothioate
agaaauggaguggccaaagtt

SEQ ID NO: 1220 - DNA, 21 bp, Artificial sequence
  Synthetic sequence: "human only" siRNA
  misc_feature (20)..(20): t is 2prime - deoxy - thymidine - 5prime - phosphorothioate
cuuuggccacuccauuucutt

SEQ ID NO: 1221 - DNA, 21 bp, Artificial sequence
  Synthetic sequence: "human only" siRNA
  misc_feature (20)..(20): t is 2prime - deoxy - thymidine - 5prime - phosphorothioate
ggagcugaacuacaaaacctt

SEQ ID NO: 1222 - DNA, 21 bp, Artificial sequence
  Synthetic sequence: "human only" siRNA
  misc_feature (20)..(20): t is 2prime - deoxy - thymidine - 5prime - phosphorothioate
gguuuuguaguucagcucctt

SEQ ID NO: 1223 - DNA, 21 bp, Artificial sequence
  Synthetic sequence: "human only" siRNA
  misc_feature (20)..(20): t is 2prime - deoxy - thymidine - 5prime - phosphorothioate
ccucugucacgauggucactt

SEQ ID NO: 1224 - DNA, 21 bp, Artificial sequence
  Synthetic sequence: "human only" siRNA
  misc_feature (20)..(20): t is 2prime - deoxy - thymidine - 5prime - phosphorothioate
gugaccaucgugacagaggtt

SEQ ID NO: 1225 - DNA, 21 bp, Artificial sequence
  Synthetic sequence: "human only" siRNA
  misc_feature (20)..(20): t is 2prime - deoxy - thymidine - 5prime - phosphorothioate
agauugaaggaugugcaggtt

SEQ ID NO: 1226 - DNA, 21 bp, Artificial sequence
  Synthetic sequence: "human only" siRNA
  misc_feature (20)..(20): t is 2prime - deoxy - thymidine - 5prime - phosphorothioate
ccugcacauccuucaaucutt

SEQ ID NO: 1227 - DNA, 21 bp, Artificial sequence
  Synthetic sequence: "human only" siRNA
  misc_feature (20)..(20): t is 2prime - deoxy - thymidine - 5prime - phosphorothioate
gagcuuugacaaggaacuutt

SEQ ID NO: 1228 - DNA, 21 bp, Artificial sequence
  Synthetic sequence: "human only" siRNA
  misc_feature (20)..(20): t is 2prime - deoxy - thymidine - 5prime - phosphorothioate
aaguuccuugucaaagcuctt

SEQ ID NO: 1229 - DNA, 21 bp, Artificial sequence
  Synthetic sequence: "human only" siRNA
  misc_feature (20)..(20): t is 2prime - deoxy - thymidine - 5prime - phosphorothioate
cuuugacaaggaacuuucctt

SEQ ID NO: 1230 - DNA, 21 bp, Artificial sequence
  Synthetic sequence: "human only" siRNA
  misc_feature (20)..(20): t is 2prime - deoxy - thymidine - 5prime - phosphorothioate
ggaaaguuccuugucaaagtt

SEQ ID NO: 1231 - DNA, 21 bp, Artificial sequence
  Synthetic sequence: "human only" siRNA
  misc_feature (20)..(20): t is 2prime - deoxy - thymidine - 5prime - phosphorothioate
ucagacaccauuacuuuugtt

SEQ ID NO: 1232 - DNA, 21 bp, Artificial sequence
  Synthetic sequence: "human only" siRNA
  misc_feature (20)..(20): t is 2prime - deoxy - thymidine - 5prime - phosphorothioate
caaaaguaauggugucugatt

SEQ ID NO: 1233 - DNA, 21 bp, Artificial sequence
  Synthetic sequence: "human only" siRNA
  misc_feature (20)..(20): t is 2prime - deoxy - thymidine - 5prime - phosphorothioate
agcacacuauaacaucugctt

SEQ ID NO: 1234 - DNA, 21 bp, Artificial sequence
  Synthetic sequence: "human only" siRNA
  misc_feature (20)..(20): t is 2prime - deoxy - thymidine - 5prime - phosphorothioate
gcagauguuauagugugcutt

SEQ ID NO: 1235 - DNA, 21 bp, Artificial sequence
  Synthetic sequence: "human only" siRNA
  misc_feature (20)..(20): t is 2prime - deoxy - thymidine - 5prime - phosphorothioate
gcacaaccgcaugaagacgtt

SEQ ID NO: 1236 - DNA, 21 bp, Artificial sequence
  Synthetic sequence: "human only" siRNA
  misc_feature (20)..(20): t is 2prime - deoxy - thymidine - 5prime - phosphorothioate
cgucuucaugcgguugugctt

SEQ ID NO: 1237 - DNA, 21 bp, Artificial sequence
  Synthetic sequence: "human only" siRNA
  misc_feature (20)..(20): t is 2prime - deoxy - thymidine - 5prime - phosphorothioate
acugcuucuaccagacauatt

SEQ ID NO: 1238 - DNA, 21 bp, Artificial sequence
  Synthetic sequence: "human only" siRNA
  misc_feature (20)..(20): t is 2prime - deoxy - thymidine - 5prime - phosphorothioate
uaugucugguagaagcagutt

SEQ ID NO: 1239 - DNA, 21 bp, Artificial sequence
  Synthetic sequence: "human only" siRNA
  misc_feature (20)..(20): t is 2prime - deoxy - thymidine - 5prime - phosphorothioate
gaagacggccuucugggcatt

SEQ ID NO: 1240 - DNA, 21 bp, Artificial sequence
  Synthetic sequence: "human only" siRNA
  misc_feature (20)..(20): t is 2prime - deoxy - thymidine - 5prime - phosphorothioate
ugcccagaaggccgucuuctt

SEQ ID NO: 1241 - DNA, 21 bp, Artificial sequence
  Synthetic sequence: "human only" siRNA
  misc_feature (20)..(20): t is 2prime - deoxy - thymidine - 5prime - phosphorothioate
aagacggccuucugggcagtt

SEQ ID NO: 1242 - DNA, 21 bp, Artificial sequence
  Synthetic sequence: "human only" siRNA
  misc_feature (20)..(20): t is 2prime - deoxy - thymidine - 5prime - phosphorothioate
cugcccagaaggccgucuutt

SEQ ID NO: 1243 - DNA, 21 bp, Artificial sequence
  Synthetic sequence: "human only" siRNA
  misc_feature (20)..(20): t is 2prime - deoxy - thymidine - 5prime - phosphorothioate
acaucaaccucaacucggatt

SEQ ID NO: 1244 - DNA, 21 bp, Artificial sequence
  Synthetic sequence: "human only" siRNA
  misc_feature (20)..(20): t is 2prime - deoxy - thymidine - 5prime - phosphorothioate
uccgaguugagguugaugutt

SEQ ID NO: 1245 - DNA, 21 bp, Artificial sequence
  Synthetic sequence: "human only" siRNA
  misc_feature (20)..(20): t is 2prime - deoxy - thymidine - 5prime - phosphorothioate
uggaaggacuggaagaucgtt

SEQ ID NO: 1246 - DNA, 21 bp, Artificial sequence
  Synthetic sequence: "human only" siRNA
  misc_feature (20)..(20): t is 2prime - deoxy - thymidine - 5prime - phosphorothioate
cgaucuuccaguccuuccatt

SEQ ID NO: 1247 - DNA, 21 bp, Artificial sequence
  Synthetic sequence: "human only" siRNA
  misc_feature (20)..(20): t is 2prime - deoxy - thymidine - 5prime - phosphorothioate
acauccugucgaggcugcctt

SEQ ID NO: 1248 - DNA, 21 bp, Artificial sequence
  Synthetic sequence: "human only" siRNA
  misc_feature (20)..(20): t is 2prime - deoxy - thymidine - 5prime - phosphorothioate
ggcagccucgacaggaugutt

SEQ ID NO: 1249 - DNA, 21 bp, Artificial sequence
  Synthetic sequence: "human only" siRNA
  misc_feature (20)..(20): t is 2prime - deoxy - thymidine - 5prime - phosphorothioate
caaccaggcgaauuacucutt

SEQ ID NO: 1250 - DNA, 21 bp, Artificial sequence
  Synthetic sequence: "human only" siRNA
  misc_feature (20)..(20): t is 2prime - deoxy - thymidine - 5prime - phosphorothioate
agaguaauucgccugguugtt

SEQ ID NO: 1251 - DNA, 21 bp, Artificial sequence
  Synthetic sequence: "human only" siRNA
  misc_feature (20)..(20): t is 2prime - deoxy - thymidine - 5prime - phosphorothioate
caggcgaauuacucucacutt

SEQ ID NO: 1252 - DNA, 21 bp, Artificial sequence
  Synthetic sequence: "human only" siRNA
  misc_feature (20)..(20): t is 2prime - deoxy - thymidine - 5prime - phosphorothioate
agugagaguaauucgccugtt

SEQ ID NO: 1253 - DNA, 21 bp, Artificial sequence
  Synthetic sequence: "human only" siRNA
  misc_feature (20)..(20): t is 2prime - deoxy - thymidine - 5prime - phosphorothioate
agcagaaugacuucauucctt

SEQ ID NO: 1254 - DNA, 21 bp, Artificial sequence
  Synthetic sequence: "human only" siRNA
  misc_feature (20)..(20): t is 2prime - deoxy - thymidine - 5prime - phosphorothioate
ggaaugaagucauucugcutt

SEQ ID NO: 1255 - DNA, 21 bp, Artificial sequence
  Synthetic sequence: "human only" siRNA
  misc_feature (20)..(20): t is 2prime - deoxy - thymidine - 5prime - phosphorothioate
augaugguggcuuuaacuutt

SEQ ID NO: 1256 - DNA, 21 bp, Artificial sequence
  Synthetic sequence: "human only" siRNA
  misc_feature (20)..(20): t is 2prime - deoxy - thymidine - 5prime - phosphorothioate
aaguuaaagccaccaucautt

SEQ ID NO: 1257 - DNA, 21 bp, Artificial sequence
  Synthetic sequence: "human only" siRNA
  misc_feature (20)..(20): t is 2prime - deoxy - thymidine - 5prime - phosphorothioate
agaaccuuuacccuucaaatt

SEQ ID NO: 1258 - DNA, 21 bp, Artificial sequence
  Synthetic sequence: "human only" siRNA
  misc_feature (20)..(20): t is 2prime - deoxy - thymidine - 5prime - phosphorothioate
uuugaaggguaaagguucutt

SEQ ID NO: 1259 - DNA, 21 bp, Artificial sequence
  Synthetic sequence: "human only" siRNA
  misc_feature (20)..(20): t is 2prime - deoxy - thymidine - 5prime - phosphorothioate
ccuuuacccuucaaaguactt

SEQ ID NO: 1260 - DNA, 21 bp, Artificial sequence
  Synthetic sequence: "human only" siRNA
  misc_feature (20)..(20): t is 2prime - deoxy - thymidine - 5prime - phosphorothioate
guacuuugaaggguaaaggtt

SEQ ID NO: 1261 - DNA, 21 bp, Artificial sequence
  Synthetic sequence: "human only" siRNA
  misc_feature (20)..(20): t is 2prime - deoxy - thymidine - 5prime - phosphorothioate
gagccugugguucggcucctt

SEQ ID NO: 1262 - DNA, 21 bp, Artificial sequence
  Synthetic sequence: "human only" siRNA
  misc_feature (20)..(20): t is 2prime - deoxy - thymidine - 5prime - phosphorothioate
ggagccgaaccacaggcuctt

SEQ ID NO: 1263 - DNA, 21 bp, Artificial sequence
  Synthetic sequence: "human only" siRNA
  misc_feature (20)..(20): t is 2prime - deoxy - thymidine - 5prime - phosphorothioate
ugguacugccucugaacactt

SEQ ID NO: 1264 - DNA, 21 bp, Artificial sequence
  Synthetic sequence: "human only" siRNA
  misc_feature (20)..(20): t is 2prime - deoxy - thymidine - 5prime - phosphorothioate
guguucagaggcaguaccatt

SEQ ID NO: 1265 - DNA, 21 bp, Artificial sequence
  Synthetic sequence: "human only" siRNA
  misc_feature (20)..(20): t is 2prime - deoxy - thymidine - 5prime - phosphorothioate
cucauacccgugcccucactt

SEQ ID NO: 1266 - DNA, 21 bp, Artificial sequence
  Synthetic sequence: "human only" siRNA
  misc_feature (20)..(20): t is 2prime - deoxy - thymidine - 5prime - phosphorothioate
gugagggcacggguaugagtt

SEQ ID NO: 1267 - DNA, 21 bp, Artificial sequence
  Synthetic sequence: "human only" siRNA
  misc_feature (20)..(20): t is 2prime - deoxy - thymidine - 5prime - phosphorothioate
ccguagcacacuauaacautt

SEQ ID NO: 1268 - DNA, 21 bp, Artificial sequence
  Synthetic sequence: "human only" siRNA
  misc_feature (20)..(20): t is 2prime - deoxy - thymidine - 5prime - phosphorothioate
auguuauagugugcuacggtt

SEQ ID NO: 1269 - DNA, 21 bp, Artificial sequence
  Synthetic sequence: "human only" siRNA
  misc_feature (20)..(20): t is 2prime - deoxy - thymidine - 5prime - phosphorothioate
cguagcacacuauaacauctt

SEQ ID NO: 1270 - DNA, 21 bp, Artificial sequence
  Synthetic sequence: "human only" siRNA
  misc_feature (20)..(20): t is 2prime - deoxy - thymidine - 5prime - phosphorothioate
gauguuauagugugcuacgtt

SEQ ID NO: 1271 - DNA, 21 bp, Artificial sequence
  Synthetic sequence: "human only" siRNA
  misc_feature (20)..(20): t is 2prime - deoxy - thymidine - 5prime - phosphorothioate
gcaggacccuagaccucugtt

SEQ ID NO: 1272 - DNA, 21 bp, Artificial sequence
  Synthetic sequence: "human only" siRNA
  misc_feature (20)..(20): t is 2prime - deoxy - thymidine - 5prime - phosphorothioate
cagaggucuaggguccugctt

SEQ ID NO: 1273 - DNA, 21 bp, Artificial sequence
  Synthetic sequence: "human only" siRNA
  misc_feature (20)..(20): t is 2prime - deoxy - thymidine - 5prime - phosphorothioate
gccugcuuuucggagaguatt

SEQ ID NO: 1274 - DNA, 21 bp, Artificial sequence
  Synthetic sequence: "human only" siRNA
  misc_feature (20)..(20): t is 2prime - deoxy - thymidine - 5prime - phosphorothioate
uacucuccgaaaagcaggctt

SEQ ID NO: 1275 - DNA, 21 bp, Artificial sequence
  Synthetic sequence: "human only" siRNA
  misc_feature (20)..(20): t is 2prime - deoxy - thymidine - 5prime - phosphorothioate
gggcccggguaauggugcatt

SEQ ID NO: 1276 - DNA, 21 bp, Artificial sequence
  Synthetic sequence: "human only" siRNA
  misc_feature (20)..(20): t is 2prime - deoxy - thymidine - 5prime - phosphorothioate
ugcaccauuacccgggccctt

SEQ ID NO: 1277 - DNA, 21 bp, Artificial sequence
  Synthetic sequence: "human only" siRNA
  misc_feature (20)..(20): t is 2prime - deoxy - thymidine - 5prime - phosphorothioate
caacaacaagagaaauggatt

SEQ ID NO: 1278 - DNA, 21 bp, Artificial sequence
  Synthetic sequence: "human only" siRNA
  misc_feature (20)..(20): t is 2prime - deoxy - thymidine - 5prime - phosphorothioate
uccauuucucuuguuguugtt

SEQ ID NO: 1279 - DNA, 21 bp, Artificial sequence
  Synthetic sequence: "human only" siRNA
  misc_feature (20)..(20): t is 2prime - deoxy - thymidine - 5prime - phosphorothioate
gcuguugcaccauacuuuctt

SEQ ID NO: 1280 - DNA, 21 bp, Artificial sequence
  Synthetic sequence: "human only" siRNA
  misc_feature (20)..(20): t is 2prime - deoxy - thymidine - 5prime - phosphorothioate
gaaaguauggugcaacagctt

SEQ ID NO: 1281 - DNA, 21 bp, Artificial sequence
  Synthetic sequence: "human only" siRNA
  misc_feature (20)..(20): t is 2prime - deoxy - thymidine - 5prime - phosphorothioate
cuaccgagagcucuucgagtt

SEQ ID NO: 1282 - DNA, 21 bp, Artificial sequence
  Synthetic sequence: "human only" siRNA
  misc_feature (20)..(20): t is 2prime - deoxy - thymidine - 5prime - phosphorothioate
cucgaagagcucucgguagtt

SEQ ID NO: 1283 - DNA, 21 bp, Artificial sequence
  Synthetic sequence: "human only" siRNA
  misc_feature (20)..(20): t is 2prime - deoxy - thymidine - 5prime - phosphorothioate
accugccuuuauggaugautt

SEQ ID NO: 1284 - DNA, 21 bp, Artificial sequence
  Synthetic sequence: "human only" siRNA
  misc_feature (20)..(20): t is 2prime - deoxy - thymidine - 5prime - phosphorothioate
aucauccauaaaggcaggutt

SEQ ID NO: 1285 - DNA, 21 bp, Artificial sequence
  Synthetic sequence: "human only" siRNA
  misc_feature (20)..(20): t is 2prime - deoxy - thymidine - 5prime - phosphorothioate
uugacaaggaacuuuccuatt

SEQ ID NO: 1286 - DNA, 21 bp, Artificial sequence
  Synthetic sequence: "human only" siRNA
  misc_feature (20)..(20): t is 2prime - deoxy - thymidine - 5prime - phosphorothioate
uaggaaaguuccuugucaatt

SEQ ID NO: 1287 - DNA, 21 bp, Artificial sequence
  Synthetic sequence: "human only" siRNA
  misc_feature (20)..(20): t is 2prime - deoxy - thymidine - 5prime - phosphorothioate
gcuggaguguugcuguugctt

SEQ ID NO: 1288 - DNA, 21 bp, Artificial sequence
  Synthetic sequence: "human only" siRNA
  misc_feature (20)..(20): t is 2prime - deoxy - thymidine - 5prime - phosphorothioate
gcaacagcaacacuccagctt

SEQ ID NO: 1289 - DNA, 21 bp, Artificial sequence
  Synthetic sequence: "human only" siRNA
  misc_feature (20)..(20): t is 2prime - deoxy - thymidine - 5prime - phosphorothioate
ucggugacaucccaggaautt

SEQ ID NO: 1290 - DNA, 21 bp, Artificial sequence
  Synthetic sequence: "human only" siRNA
  misc_feature (20)..(20): t is 2prime - deoxy - thymidine - 5prime - phosphorothioate
auuccugggaugucaccgatt

SEQ ID NO: 1291 - DNA, 21 bp, Artificial sequence
  Synthetic sequence: "human only" siRNA
  misc_feature (20)..(20): t is 2prime - deoxy - thymidine - 5prime - phosphorothioate
gcugcccagaagugccuugtt

SEQ ID NO: 1292 - DNA, 21 bp, Artificial sequence
  Synthetic sequence: "human only" siRNA
  misc_feature (20)..(20): t is 2prime - deoxy - thymidine - 5prime - phosphorothioate
caaggcacuucugggcagctt

SEQ ID NO: 1293 - DNA, 21 bp, Artificial sequence
  Synthetic sequence: "human only" siRNA
  misc_feature (20)..(20): t is 2prime - deoxy - thymidine - 5prime - phosphorothioate
aguacacacagcaggugugtt

SEQ ID NO: 1294 - DNA, 21 bp, Artificial sequence
  Synthetic sequence: "human only" siRNA
  misc_feature (20)..(20): t is 2prime - deoxy - thymidine - 5prime - phosphorothioate
cacaccugcuguguguacutt

SEQ ID NO: 1295 - DNA, 21 bp, Artificial sequence
  Synthetic sequence: "human only" siRNA
  misc_feature (20)..(20): t is 2prime - deoxy - thymidine - 5prime - phosphorothioate
caagugccggaagccaugctt

SEQ ID NO: 1296 - DNA, 21 bp, Artificial sequence
  Synthetic sequence: "human only" siRNA
  misc_feature (20)..(20): t is 2prime - deoxy - thymidine - 5prime - phosphorothioate
gcauggcuuccggcacuugtt

SEQ ID NO: 1297 - DNA, 21 bp, Artificial sequence
  Synthetic sequence: human-rat cross-reactive siRNA
  modified_base (1)..(1): um
  modified_base (3)..(3): um
  modified_base (5)..(5): cm
  modified_base (8)..(9): cm
  modified_base (14)..(14): cm
  modified_base (18)..(18): um
  modified_base (19)..(19): cm
  misc_feature (20)..(20): t is 2prime - deoxy - thymidine - 5prime - phosphorothioate
ugugcaaccagaacaaauctt

SEQ ID NO: 1298 - DNA, 21 bp, Artificial sequence
  Synthetic sequence: human-rat cross-reactive siRNA
  modified_base (16)..(16): cm
  modified_base (18)..(18): cm
  misc_feature (20)..(20): t is 2prime - deoxy - thymidine - 5prime - phosphorothioate
gauuuguucugguugcacatt

SEQ ID NO: 1299 - DNA, 21 bp, Artificial sequence
  Synthetic sequence: human-rat cross-reactive siRNA
  modified_base (1)..(3): um
  modified_base (5)..(5): um
  modified_base (9)..(9): um
  modified_base (12)..(12): um
  modified_base (15)..(15): um
  modified_base (18)..(18): cm
  modified_base (19)..(19): um
  misc_feature (20)..(20): t is 2prime - deoxy - thymidine - 5prime - phosphorothioate
uuuauggaugaugguggcutt

SEQ ID NO: 1300 - DNA, 21 bp, Artificial sequence
  Synthetic sequence: human-rat cross-reactive siRNA
  modified_base (4)..(4): cm
  modified_base (7)..(7): cm
  modified_base (10)..(10): cm
  modified_base (14)..(14): cm
  modified_base (16)..(16): um
  misc_feature (20)..(20): t is 2prime - deoxy - thymidine - 5prime - phosphorothioate
agccaccaucauccauaaatt

SEQ ID NO: 1301 - DNA, 21 bp, Artificial sequence
  Synthetic sequence: human-rat cross-reactive siRNA
  modified_base (2)..(3): cm
  modified_base (4)..(6): um
  modified_base (8)..(8): um
  modified_base (12)..(12): um
  modified_base (15)..(15): um
  modified_base (18)..(18): um
  misc_feature (20)..(20): t is 2prime - deoxy - thymidine - 5prime - phosphorothioate
gccuuuauggaugauggugtt

SEQ ID NO: 1302 - DNA, 21 bp, Artificial sequence
  Synthetic sequence: human-rat cross-reactive siRNA
  modified_base (1)..(1): cm
  modified_base (4)..(4): cm
  modified_base (7)..(7): cm
  modified_base (11)..(11): cm
  modified_base (13)..(13): um
  misc_feature (20)..(20): t is 2prime - deoxy - thymidine - 5prime - phosphorothioate
caccaucauccauaaaggctt

SEQ ID NO: 1303 - DNA, 21 bp, Artificial sequence
  Synthetic sequence: human-rat cross-reactive siRNA
  modified_base (1)..(1): cm
  modified_base (3)..(3): cm
  modified_base (6)..(7): cm
  modified_base (9)..(9): cm
  modified_base (11)..(11): um
  modified_base (17)..(17): cm
  misc_feature (20)..(20): t is 2prime - deoxy - thymidine - 5prime - phosphorothioate
cacaaccgcaugaagacggtt

SEQ ID NO: 1304 - DNA, 21 bp, Artificial sequence
  Synthetic sequence: human-rat cross-reactive siRNA
  modified_base (8)..(8): cm
  misc_feature (20)..(20): t is 2prime - deoxy - thymidine - 5prime - phosphorothioate
ccgucuucaugcgguugugtt

SEQ ID NO: 1305 - DNA, 21 bp, Artificial sequence
  Synthetic sequence: human-rat cross-reactive siRNA
  modified_base (2)..(3): cm
  modified_base (5)..(5): cm
  modified_base (7)..(7): um
  modified_base (13)..(13): cm
  modified_base (16)..(17): cm
  modified_base (18)..(19): um
  misc_feature (20)..(20): t is 2prime - deoxy - thymidine - 5prime - phosphorothioate
accgcaugaagacggccuutt

SEQ ID NO: 1306 - DNA, 21 bp, Artificial sequence
  Synthetic sequence: human-rat cross-reactive siRNA
  modified_base (12)..(12): cm
  misc_feature (20)..(20): t is 2prime - deoxy - thymidine - 5prime - phosphorothioate
aaggccgucuucaugcggutt

SEQ ID NO: 1307 - DNA, 21 bp, Artificial sequence
  Synthetic sequence: human-rat cross-reactive siRNA
  modified_base (5)..(5): cm
  modified_base (6)..(6): um
  modified_base (13)..(13): um
  modified_base (14)..(14): cm
  modified_base (17)..(17): cm
  modified_base (18)..(19): um
  misc_feature (20)..(20): t is 2prime - deoxy - thymidine - 5prime - phosphorothioate
aggacuggaagaucggcuutt

SEQ ID NO: 1308 - DNA, 21 bp, Artificial sequence
  Synthetic sequence: human-rat cross-reactive siRNA
  modified_base (13)..(13): cm
  misc_feature (20)..(20): t is 2prime - deoxy - thymidine - 5prime - phosphorothioate
aagccgaucuuccaguccutt

SEQ ID NO: 1309 - DNA, 21 bp, Artificial sequence
  Synthetic sequence: human-rat cross-reactive siRNA
  modified_base (7)..(7): cm
  modified_base (8)..(8): um
  modified_base (15)..(15): um
  modified_base (16)..(16): cm
  modified_base (19)..(19): cm
  misc_feature (20)..(20): t is 2prime - deoxy - thymidine - 5prime - phosphorothioate
gaaggacuggaagaucggctt

SEQ ID NO: 1310 - DNA, 21 bp, Artificial sequence
  Synthetic sequence: human-rat cross-reactive siRNA
  modified_base (11)..(11): cm
  misc_feature (20)..(20): t is 2prime - deoxy - thymidine - 5prime - phosphorothioate
gccgaucuuccaguccuuctt

SEQ ID NO: 1311 - DNA, 21 bp, Artificial sequence
  Synthetic sequence: human-rat cross-reactive siRNA
  modified_base (4)..(4): cm
  modified_base (5)..(5): um
  modified_base (12)..(12): um
  modified_base (13)..(13): cm
  modified_base (16)..(16): cm
  modified_base (17)..(18): um
  modified_base (19)..(19): cm
  misc_feature (20)..(20): t is 2prime - deoxy - thymidine - 5prime - phosphorothioate
ggacuggaagaucggcuuctt

SEQ ID NO: 1312 - DNA, 21 bp, Artificial sequence
  Synthetic sequence: human-rat cross-reactive siRNA
  modified_base (14)..(14): cm
  misc_feature (20)..(20): t is 2prime - deoxy - thymidine - 5prime - phosphorothioate
gaagccgaucuuccagucctt

SEQ ID NO: 1313 - DNA, 21 bp, Artificial sequence
  Synthetic sequence: human-rat cross-reactive siRNA
  modified_base (3)..(4): um
  modified_base (5)..(6): cm
  modified_base (8)..(9): cm
  modified_base (11)..(11): cm
  modified_base (12)..(12): um
  modified_base (13)..(14): cm
  modified_base (15)..(15): um
  modified_base (17)..(18): cm
  misc_feature (20)..(20): t is 2prime - deoxy - thymidine - 5prime - phosphorothioate
aguuccaccgcuccuaccgtt

SEQ ID NO: 1314 - DNA, 21 bp, Artificial sequence
  Synthetic sequence: human-rat cross-reactive siRNA
  modified_base (4)..(4): um
  misc_feature (20)..(20): t is 2prime - deoxy - thymidine - 5prime - phosphorothioate
cgguaggagcgguggaacutt

SEQ ID NO: 1315 - DNA, 21 bp, Artificial sequence
  Synthetic sequence: human-rat cross-reactive siRNA
  modified_base (3)..(3): cm
  modified_base (4)..(4): um
  modified_base (11)..(11): um
  modified_base (12)..(12): cm
  modified_base (15)..(15): cm
  modified_base (16)..(17): um
  modified_base (18)..(19): cm
  misc_feature (20)..(20): t is 2prime - deoxy - thymidine - 5prime - phosphorothioate
gacuggaagaucggcuucctt

SEQ ID NO: 1316 - DNA, 21 bp, Artificial sequence
  Synthetic sequence: human-rat cross-reactive siRNA
  modified_base (15)..(15): cm
  misc_feature (20)..(20): t is 2prime - deoxy - thymidine - 5prime - phosphorothioate
ggaagccgaucuuccaguctt

SEQ ID NO: 1317 - DNA, 21 bp, Artificial sequence
  Synthetic sequence: human-rat cross-reactive siRNA
  modified_base (1)..(1): cm
  modified_base (3)..(3): cm
  modified_base (5)..(5): um
  modified_base (11)..(11): cm
  modified_base (14)..(15): cm
  modified_base (16)..(17): um
  modified_base (18)..(18): cm
  modified_base (19)..(19): um
  misc_feature (20)..(20): t is 2prime - deoxy - thymidine - 5prime - phosphorothioate
cgcaugaagacggccuucutt

SEQ ID NO: 1318 - DNA, 21 bp, Artificial sequence
  Synthetic sequence: human-rat cross-reactive siRNA
  modified_base (14)..(14): cm
  misc_feature (20)..(20): t is 2prime - deoxy - thymidine - 5prime - phosphorothioate
agaaggccgucuucaugcgtt

SEQ ID NO: 1319 - DNA, 21 bp, Artificial sequence
  Synthetic sequence: human-rat cross-reactive siRNA
  modified_base (2)..(3): cm
  modified_base (6)..(6): um
  modified_base (11)..(12): cm
  modified_base (13)..(13): um
  modified_base (15)..(15): um
  modified_base (18)..(19): um
  misc_feature (20)..(20): t is 2prime - deoxy - thymidine - 5prime - phosphorothioate
gccaguggagccugugguutt

SEQ ID NO: 1320 - DNA, 21 bp, Artificial sequence
  Synthetic sequence: human-rat cross-reactive siRNA
  modified_base (4)..(4): cm
  modified_base (6)..(6): cm
  modified_base (13)..(13): cm
  misc_feature (20)..(20): t is 2prime - deoxy - thymidine - 5prime - phosphorothioate
aaccacaggcuccacuggctt

SEQ ID NO: 1321 - DNA, 21 bp, Artificial sequence
  Synthetic sequence: human-rat cross-reactive siRNA
  modified_base (1)..(1): um
  modified_base (3)..(4): cm
  modified_base (5)..(7): um
  modified_base (9)..(9): um
  modified_base (13)..(13): um
  modified_base (16)..(16): um
  modified_base (19)..(19): um
  misc_feature (20)..(20): t is 2prime - deoxy - thymidine - 5prime - phosphorothioate
ugccuuuauggaugauggutt

SEQ ID NO: 1322 - DNA, 21 bp, Artificial sequence
  Synthetic sequence: human-rat cross-reactive siRNA
  modified_base (3)..(3): cm
  modified_base (6)..(6): cm
  modified_base (10)..(10): cm
  modified_base (12)..(12): um
  modified_base (18)..(18): cm
  misc_feature (20)..(20): t is 2prime - deoxy - thymidine - 5prime - phosphorothioate
accaucauccauaaaggcatt

SEQ ID NO: 1323 - DNA, 21 bp, Artificial sequence
  Synthetic sequence: human-rat cross-reactive siRNA
  modified_base (1)..(1): um
  modified_base (2)..(3): cm
  modified_base (4)..(4): um
  modified_base (6)..(6): um
  modified_base (7)..(8): cm
  modified_base (11)..(12): cm
  modified_base (13)..(13): um
  modified_base (17)..(17): cm
  misc_feature (20)..(20): t is 2prime - deoxy - thymidine - 5prime - phosphorothioate
uccuguccaaccugggcagtt

SEQ ID NO: 1324 - DNA, 21 bp, Artificial sequence
  Synthetic sequence: human-rat cross-reactive siRNA
  modified_base (6)..(6): cm
  modified_base (15)..(15): cm
  misc_feature (20)..(20): t is 2prime - deoxy - thymidine - 5prime - phosphorothioate
cugcccagguuggacaggatt

SEQ ID NO: 1325 - DNA, 21 bp, Artificial sequence
  Synthetic sequence: human-rat cross-reactive siRNA
  modified_base (7)..(7): um
  modified_base (10)..(10): um
  modified_base (12)..(13): cm
  modified_base (15)..(15): cm
  modified_base (16)..(17): um
  modified_base (18)..(19): cm
  misc_feature (20)..(20): t is 2prime - deoxy - thymidine - 5prime - phosphorothioate
agggagugguaccgcuucctt

SEQ ID NO: 1326 - DNA, 21 bp, Artificial sequence
  Synthetic sequence: human-rat cross-reactive siRNA
  modified_base (9)..(9): um
  modified_base (12)..(12): cm
  misc_feature (20)..(20): t is 2prime - deoxy - thymidine - 5prime - phosphorothioate
ggaagcgguaccacucccutt

SEQ ID NO: 1327 - DNA, 21 bp, Artificial sequence
  Synthetic sequence: human-rat cross-reactive siRNA
  modified_base (3)..(3): cm
  modified_base (4)..(4): um
  modified_base (6)..(6): um
  modified_base (8)..(9): cm
  modified_base (10)..(10): um
  modified_base (12)..(12): cm
  modified_base (14)..(14): um
  modified_base (15)..(15): cm
  modified_base (16)..(17): um
  modified_base (18)..(18): cm
  modified_base (19)..(19): um
  misc_feature (20)..(20): t is 2prime - deoxy - thymidine - 5prime - phosphorothioate
ggcugugccuacaucuucutt

SEQ ID NO: 1328 - DNA, 21 bp, Artificial sequence
  Synthetic sequence: human-rat cross-reactive siRNA
  modified_base (9)..(9): um
  modified_base (13)..(13): cm
  modified_base (15)..(15): cm
  misc_feature (20)..(20): t is 2prime - deoxy - thymidine - 5prime - phosphorothioate
agaagauguaggcacagcctt

SEQ ID NO: 1329 - DNA, 21 bp, Artificial sequence
  Synthetic sequence: human-rat cross-reactive siRNA
  modified_base (5)..(6): um
  modified_base (16)..(16): cm
  modified_base (17)..(17): um
  misc_feature (20)..(20): t is 2prime - deoxy - thymidine - 5prime - phosphorothioate
gaaauuaaagaggagcuggtt

SEQ ID NO: 1330 - DNA, 21 bp, Artificial sequence
  Synthetic sequence: human-rat cross-reactive siRNA
  modified_base (2)..(2): cm
  modified_base (13)..(13): um
  misc_feature (20)..(20): t is 2prime - deoxy - thymidine - 5prime - phosphorothioate
ccagcuccucuuuaauuuctt

SEQ ID NO: 1331 - DNA, 21 bp, Artificial sequence
  Synthetic sequence: human-rat cross-reactive siRNA
  modified_base (2)..(2): cm
  modified_base (3)..(3): um
  modified_base (10)..(10): um
  modified_base (11)..(11): cm
  modified_base (14)..(14): cm
  modified_base (15)..(16): um
  modified_base (17)..(18): cm
  misc_feature (20)..(20): t is 2prime - deoxy - thymidine - 5prime - phosphorothioate
acuggaagaucggcuuccatt

SEQ ID NO: 1332 - DNA, 21 bp, Artificial sequence
  Synthetic sequence: human-rat cross-reactive siRNA
  modified_base (16)..(16): cm
  misc_feature (20)..(20): t is 2prime - deoxy - thymidine - 5prime - phosphorothioate
uggaagccgaucuuccagutt

SEQ ID NO: 1333 - DNA, 21 bp, Artificial sequence
  Synthetic sequence: human-rat cross-reactive siRNA
  modified_base (1)..(2): cm
  modified_base (3)..(3): um
  modified_base (5)..(5): um
  modified_base (6)..(7): cm
  modified_base (10)..(11): cm
  modified_base (12)..(12): um
  modified_base (16)..(16): cm
  modified_base (19)..(19): cm
  misc_feature (20)..(20): t is 2prime - deoxy - thymidine - 5prime - phosphorothioate
ccuguccaaccugggcagctt

SEQ ID NO: 1334 - DNA, 21 bp, Artificial sequence
  Synthetic sequence: human-rat cross-reactive siRNA
  modified_base (7)..(7): cm
  modified_base (16)..(16): cm
  misc_feature (20)..(20): t is 2prime - deoxy - thymidine - 5prime - phosphorothioate
gcugcccagguuggacaggtt

SEQ ID NO: 1335 - DNA, 21 bp, Artificial sequence
  Synthetic sequence: human-rat cross-reactive siRNA
  modified_base (1)..(2): cm
  modified_base (3)..(3): um
  modified_base (5)..(6): cm
  modified_base (7)..(9): um
  modified_base (11)..(11): um
  modified_base (15)..(15): um
  modified_base (18)..(18): um
  misc_feature (20)..(20): t is 2prime - deoxy - thymidine - 5prime - phosphorothioate
ccugccuuuauggaugaugtt

SEQ ID NO: 1336 - DNA, 21 bp, Artificial sequence
  Synthetic sequence: human-rat cross-reactive siRNA
  modified_base (1)..(1): cm
  modified_base (4)..(4): cm
  modified_base (8)..(8): cm
  modified_base (10)..(10): um
  modified_base (16)..(16): cm
  misc_feature (20)..(20): t is 2prime - deoxy - thymidine - 5prime - phosphorothioate
caucauccauaaaggcaggtt

SEQ ID NO: 1337 - DNA, 21 bp, Artificial sequence
  Synthetic sequence: human-rat cross-reactive siRNA
  modified_base (3)..(4): cm
  modified_base (6)..(6): cm
  modified_base (8)..(8): um
  modified_base (14)..(14): cm
  modified_base (17)..(18): cm
  modified_base (19)..(19): um
  misc_feature (20)..(20): t is 2prime - deoxy - thymidine - 5prime - phosphorothioate
aaccgcaugaagacggccutt

SEQ ID NO: 1338 - DNA, 21 bp, Artificial sequence
  Synthetic sequence: human-rat cross-reactive siRNA
  modified_base (11)..(11): cm
  misc_feature (20)..(20): t is 2prime - deoxy - thymidine - 5prime - phosphorothioate
aggccgucuucaugcgguutt

SEQ ID NO: 1339 - DNA, 21 bp, Artificial sequence
  Synthetic sequence: human-rat cross-reactive siRNA
  modified_base (1)..(1): um
  modified_base (3)..(3): um
  modified_base (4)..(5): cm
  modified_base (8)..(9): cm
  modified_base (10)..(10): um
  modified_base (14)..(14): cm
  modified_base (17)..(18): cm
  misc_feature (20)..(20): t is 2prime - deoxy - thymidine - 5prime - phosphorothioate
uguccaaccugggcagccatt

SEQ ID NO: 1340 - DNA, 21 bp, Artificial sequence
  Synthetic sequence: human-rat cross-reactive siRNA
  modified_base (9)..(9): cm
  modified_base (18)..(18): cm
  misc_feature (20)..(20): t is 2prime - deoxy - thymidine - 5prime - phosphorothioate
uggcugcccagguuggacatt

SEQ ID NO: 1341 - DNA, 21 bp, Artificial sequence
  Synthetic sequence: human-rat cross-reactive siRNA
  modified_base (2)..(2): um
  modified_base (3)..(4): cm
  modified_base (7)..(8): cm
  modified_base (9)..(9): um
  modified_base (13)..(13): cm
  modified_base (16)..(17): cm
  misc_feature (20)..(20): t is 2prime - deoxy - thymidine - 5prime - phosphorothioate
guccaaccugggcagccagtt

SEQ ID NO: 1342 - DNA, 21 bp, Artificial sequence
  Synthetic sequence: human-rat cross-reactive siRNA
  modified_base (10)..(10): cm
  misc_feature (20)..(20): t is 2prime - deoxy - thymidine - 5prime - phosphorothioate
cuggcugcccagguuggactt

SEQ ID NO: 1343 - DNA, 21 bp, Artificial sequence
  Synthetic sequence: human-rat cross-reactive siRNA
  modified_base (4)..(5): um
  modified_base (15)..(15): cm
  modified_base (16)..(16): um
  misc_feature (20)..(20): t is 2prime - deoxy - thymidine - 5prime - phosphorothioate
aaauuaaagaggagcuggatt

SEQ ID NO: 1344 - DNA, 21 bp, Artificial sequence
  Synthetic sequence: human-rat cross-reactive siRNA
  modified_base (3)..(3): cm
  modified_base (14)..(14): um
  misc_feature (20)..(20): t is 2prime - deoxy - thymidine - 5prime - phosphorothioate
uccagcuccucuuuaauuutt

SEQ ID NO: 1345 - DNA, 21 bp, Artificial sequence
  Synthetic sequence: human-rat cross-reactive siRNA
  modified_base (8)..(8): cm
  modified_base (9)..(9): um
  modified_base (16)..(16): um
  modified_base (17)..(17): cm
  misc_feature (20)..(20): t is 2prime - deoxy - thymidine - 5prime - phosphorothioate
ggaaggacuggaagaucggtt

SEQ ID NO: 1346 - DNA, 21 bp, Artificial sequence
  Synthetic sequence: human-rat cross-reactive siRNA
  modified_base (10)..(10): cm
  misc_feature (20)..(20): t is 2prime - deoxy - thymidine - 5prime - phosphorothioate
ccgaucuuccaguccuucctt

SEQ ID NO: 1347 - DNA, 21 bp, Artificial sequence
  Synthetic sequence: human-rat cross-reactive siRNA
  modified_base (2)..(2): um
  modified_base (10)..(10): um
  modified_base (13)..(13): um
  modified_base (15)..(16): cm
  modified_base (18)..(18): cm
  modified_base (19)..(19): um
  misc_feature (20)..(20): t is 2prime - deoxy - thymidine - 5prime - phosphorothioate
gugagggagugguaccgcutt

SEQ ID NO: 1348 - DNA, 21 bp, Artificial sequence
  Synthetic sequence: human-rat cross-reactive siRNA
  modified_base (6)..(6): um
  modified_base (9)..(9): cm
  modified_base (17)..(17): cm
  misc_feature (20)..(20): t is 2prime - deoxy - thymidine - 5prime - phosphorothioate
agcgguaccacucccucactt

SEQ ID NO: 1349 - DNA, 21 bp, Artificial sequence
  Synthetic sequence: human-rat cross-reactive siRNA
  modified_base (2)..(2): cm
  modified_base (3)..(5): um
  modified_base (6)..(6): cm
  modified_base (9)..(9): um
  modified_base (12)..(12): cm
  modified_base (18)..(18): cm
  misc_feature (20)..(20): t is 2prime - deoxy - thymidine - 5prime - phosphorothioate
acuuucaaugacaagaacatt

SEQ ID NO: 1350 - DNA, 21 bp, Artificial sequence
  Synthetic sequence: human-rat cross-reactive siRNA
  modified_base (10)..(10): cm
  misc_feature (20)..(20): t is 2prime - deoxy - thymidine - 5prime - phosphorothioate
uguucuugucauugaaagutt

SEQ ID NO: 1351 - DNA, 21 bp, Artificial sequence
  Synthetic sequence: human-rat cross-reactive siRNA
  modified_base (1)..(1): um
  modified_base (2)..(2): cm
  modified_base (5)..(5): um
  modified_base (8)..(8): cm
  modified_base (14)..(14): cm
  modified_base (17)..(17): cm
  modified_base (18)..(18): um
  modified_base (19)..(19): cm
  misc_feature (20)..(20): t is 2prime - deoxy - thymidine - 5prime - phosphorothioate
ucaaugacaagaacaacuctt

SEQ ID NO: 1352 - DNA, 21 bp, Artificial sequence
  Synthetic sequence: human-rat cross-reactive siRNA
  modified_base (14)..(14): cm
  misc_feature (20)..(20): t is 2prime - deoxy - thymidine - 5prime - phosphorothioate
gaguuguucuugucauugatt

SEQ ID NO: 1353 - DNA, 21 bp, Artificial sequence
  Synthetic sequence: human-rat cross-reactive siRNA
  modified_base (1)..(1): cm
  modified_base (2)..(4): um
  modified_base (6)..(6): um
  modified_base (10)..(10): um
  modified_base (13)..(13): um
  modified_base (16)..(16): um
  modified_base (19)..(19): cm
  misc_feature (20)..(20): t is 2prime - deoxy - thymidine - 5prime - phosphorothioate
cuuuauggaugaugguggctt

SEQ ID NO: 1354 - DNA, 21 bp, Artificial sequence
  Synthetic sequence: human-rat cross-reactive siRNA
  modified_base (3)..(3): cm
  modified_base (6)..(6): cm
  modified_base (9)..(9): cm
  modified_base (13)..(13): cm
  modified_base (15)..(15): um
  misc_feature (20)..(20): t is 2prime - deoxy - thymidine - 5prime - phosphorothioate
gccaccaucauccauaaagtt

SEQ ID NO: 1355 - DNA, 21 bp, Artificial sequence
  Synthetic sequence: human-rat cross-reactive siRNA
  modified_base (2)..(3): cm
  modified_base (4)..(4): um
  modified_base (9)..(9): um
  modified_base (7)..(7): cm
  modified_base (15)..(16): cm
  modified_base (17)..(17): um
  modified_base (18)..(19): cm
  misc_feature (20)..(20): t is 2prime - deoxy - thymidine - 5prime - phosphorothioate
gccuggcguggagaccucctt

SEQ ID NO: 1356 - DNA, 21 bp, Artificial sequence
  Synthetic sequence: human-rat cross-reactive siRNA
  modified_base (10)..(10): cm
  modified_base (15)..(15): cm
  misc_feature (20)..(20): t is 2prime - deoxy - thymidine - 5prime - phosphorothioate
ggaggucuccacgccaggctt

SEQ ID NO: 1357 - DNA, 21 bp, Artificial sequence
  Synthetic sequence: human-rat cross-reactive siRNA
  modified_base (1)..(1): um
  modified_base (4)..(4): cm
  modified_base (6)..(6): um
  modified_base (12)..(13): cm
  modified_base (14)..(14): um
  modified_base (15)..(16): cm
  modified_base (18)..(18): um
  modified_base (19)..(19): cm
  misc_feature (20)..(20): t is 2prime - deoxy - thymidine - 5prime - phosphorothioate
uggcguggagaccuccauctt

SEQ ID NO: 1358 - DNA, 21 bp, Artificial sequence
  Synthetic sequence: human-rat cross-reactive siRNA
  modified_base (13)..(13): cm
  modified_base (18)..(18): cm
  misc_feature (20)..(20): t is 2prime - deoxy - thymidine - 5prime - phosphorothioate
gauggaggucuccacgccatt

SEQ ID NO: 1359 - DNA, 21 bp, Artificial sequence
  Synthetic sequence: human-rat cross-reactive siRNA
  modified_base (4)..(5): um
  modified_base (6)..(7): cm
  modified_base (9)..(10): cm
  modified_base (12)..(12): cm
  modified_base (13)..(13): um
  modified_base (14)..(15): cm
  modified_base (16)..(16): um
  modified_base (18)..(19): cm
  misc_feature (20)..(20): t is 2prime - deoxy - thymidine - 5prime - phosphorothioate
gaguuccaccgcuccuacctt

SEQ ID NO: 1360 - DNA, 21 bp, Artificial sequence
  Synthetic sequence: human-rat cross-reactive siRNA
  modified_base (3)..(3): um
  misc_feature (20)..(20): t is 2prime - deoxy - thymidine - 5prime - phosphorothioate
gguaggagcgguggaacuctt

SEQ ID NO: 1361 - DNA, 21 bp, Artificial sequence
  Synthetic sequence: human-rat cross-reactive siRNA
  modified_base (1)..(1): cm
  modified_base (6)..(6): cm
  modified_base (11)..(11): um
  modified_base (14)..(14): cm
  modified_base (15)..(16): um
  modified_base (17)..(17): cm
  modified_base (19)..(19): um
  misc_feature (20)..(20): t is 2prime - deoxy - thymidine - 5prime - phosphorothioate
cagagcagaaugacuucautt

SEQ ID NO: 1362 - DNA, 21 bp, Artificial sequence
  Synthetic sequence: human-rat cross-reactive siRNA
  modified_base (8)..(8): cm
  misc_feature (20)..(20): t is 2prime - deoxy - thymidine - 5prime - phosphorothioate
augaagucauucugcucugtt

SEQ ID NO: 1363 - DNA, 21 bp, Artificial sequence
  Synthetic sequence: human-rat cross-reactive siRNA
  modified_base (1)..(2): um
  modified_base (3)..(3): cm
  modified_base (5)..(5): cm
  modified_base (6)..(6): um
  modified_base (7)..(8): cm
  modified_base (9)..(9): um
  modified_base (11)..(11): cm
  modified_base (12)..(13): um
  modified_base (14)..(15): cm
  misc_feature (20)..(20): t is 2prime - deoxy - thymidine - 5prime - phosphorothioate
uucacuccugcuuccaggatt

SEQ ID NO: 1364 - DNA, 21 bp, Artificial sequence
  Synthetic sequence: human-rat cross-reactive siRNA
  modified_base (10)..(10): cm
  misc_feature (20)..(20): t is 2prime - deoxy - thymidine - 5prime - phosphorothioate
uccuggaagcaggagugaatt

SEQ ID NO: 1365 - DNA, 21 bp, Artificial sequence
  Synthetic sequence: human-rat cross-reactive siRNA
  modified_base (1)..(1): um
  modified_base (2)..(2): cm
  modified_base (4)..(4): cm
  modified_base (5)..(5): um
  modified_base (6)..(7): cm
  modified_base (8)..(8): um
  modified_base (10)..(10): cm
  modified_base (11)..(12): um
  modified_base (13)..(14): cm
  misc_feature (20)..(20): t is 2prime - deoxy - thymidine - 5prime - phosphorothioate
ucacuccugcuuccaggagtt

SEQ ID NO: 1366 - DNA, 21 bp, Artificial sequence
  Synthetic sequence: human-rat cross-reactive siRNA
  modified_base (11)..(11): cm
  misc_feature (20)..(20): t is 2prime - deoxy - thymidine - 5prime - phosphorothioate
cuccuggaagcaggagugatt

SEQ ID NO: 1367 - DNA, 21 bp, Artificial sequence
  Synthetic sequence: human-rat cross-reactive siRNA
  modified_base (1)..(1): cm
  modified_base (2)..(2): um
  modified_base (4)..(4): um
  modified_base (6)..(6): cm
  modified_base (9)..(10): cm
  modified_base (15)..(15): cm
  modified_base (19)..(19): um
  misc_feature (20)..(20): t is 2prime - deoxy - thymidine - 5prime - phosphorothioate
cugugcaaccagaacaaautt

SEQ ID NO: 1368 - DNA, 21 bp, Artificial sequence
  Synthetic sequence: human-rat cross-reactive siRNA
  modified_base (15)..(15): cm
  modified_base (17)..(17): cm
  misc_feature (20)..(20): t is 2prime - deoxy - thymidine - 5prime - phosphorothioate
auuuguucugguugcacagtt

SEQ ID NO: 1369 - DNA, 21 bp, Artificial sequence
  Synthetic sequence: human-rat cross-reactive siRNA
  modified_base (1)..(1): cm
  modified_base (2)..(2): um
  modified_base (4)..(4): cm
  modified_base (7)..(7): cm
  modified_base (10)..(10): cm
  modified_base (12)..(13): cm
  modified_base (15)..(16): cm
  modified_base (18)..(18): um
  modified_base (19)..(19): cm
  misc_feature (20)..(20): t is 2prime - deoxy - thymidine - 5prime - phosphorothioate
cugcaacaacaccaccauctt

SEQ ID NO: 1370 - DNA, 21 bp, Artificial sequence
  Synthetic sequence: human-rat cross-reactive siRNA
  modified_base (17)..(17): cm
  misc_feature (20)..(20): t is 2prime - deoxy - thymidine - 5prime - phosphorothioate
gauggugguguuguugcagtt

SEQ ID NO: 1371 - DNA, 21 bp, Artificial sequence
  Synthetic sequence: human-rat cross-reactive siRNA
  modified_base (1)..(1): um
  modified_base (3)..(3): um
  modified_base (6)..(6): cm
  modified_base (7)..(7): um
  modified_base (9)..(9): um
  modified_base (11)..(12): cm
  modified_base (13)..(13): um
  modified_base (15)..(15): cm
  modified_base (17)..(17): um
  modified_base (18)..(18): cm
  modified_base (19)..(19): um
  misc_feature (20)..(20): t is 2prime - deoxy - thymidine - 5prime - phosphorothioate
uguggcugugccuacaucutt

SEQ ID NO: 1372 - DNA, 21 bp, Artificial sequence
  Synthetic sequence: human-rat cross-reactive siRNA
  modified_base (6)..(6): um
  modified_base (10)..(10): cm
  modified_base (12)..(12): cm
  modified_base (16)..(16): cm
  modified_base (18)..(18): cm
  misc_feature (20)..(20): t is 2prime - deoxy - thymidine - 5prime - phosphorothioate
agauguaggcacagccacatt

SEQ ID NO: 1373 - DNA, 21 bp, Artificial sequence
  Synthetic sequence: human-rat cross-reactive siRNA
  modified_base (1)..(1): um
  modified_base (4)..(4): cm
  modified_base (5)..(5): um
  modified_base (7)..(7): um
  modified_base (9)..(10): cm
  modified_base (11)..(11): um
  modified_base (13)..(13): cm
  modified_base (15)..(15): um
  modified_base (16)..(16): cm
  modified_base (17)..(18): um
  modified_base (19)..(19): cm
  misc_feature (20)..(20): t is 2prime - deoxy - thymidine - 5prime - phosphorothioate
uggcugugccuacaucuuctt

SEQ ID NO: 1374 - DNA, 21 bp, Artificial sequence
  Synthetic sequence: human-rat cross-reactive siRNA
  modified_base (8)..(8): um
  modified_base (12)..(12): cm
  modified_base (14)..(14): cm
  modified_base (18)..(18): cm
  misc_feature (20)..(20): t is 2prime - deoxy - thymidine - 5prime - phosphorothioate
gaagauguaggcacagccatt

SEQ ID NO: 1375 - DNA, 21 bp, Artificial sequence
  Synthetic sequence: human-rat cross-reactive siRNA
  modified_base (1)..(1): cm
  modified_base (2)..(2): um
  modified_base (4)..(4): um
  modified_base (5)..(6): cm
  modified_base (9)..(10): cm
  modified_base (11)..(11): um
  modified_base (15)..(15): cm
  modified_base (18)..(19): cm
  misc_feature (20)..(20): t is 2prime - deoxy - thymidine - 5prime - phosphorothioate
cuguccaaccugggcagcctt

SEQ ID NO: 1376 - DNA, 21 bp, Artificial sequence
  Synthetic sequence: human-rat cross-reactive siRNA
  modified_base (8)..(8): cm
  modified_base (17)..(17): cm
  misc_feature (20)..(20): t is 2prime - deoxy - thymidine - 5prime - phosphorothioate
ggcugcccagguuggacagtt

SEQ ID NO: 1377 - DNA, 21 bp, Artificial sequence
  Synthetic sequence: human-rat cross-reactive siRNA
  modified_base (1)..(3): cm
  modified_base (4)..(4): um
  modified_base (6)..(6): cm
  modified_base (7)..(7): um
  modified_base (9)..(9): um
  modified_base (10)..(11): cm
  modified_base (13)..(13): cm
  modified_base (16)..(16): um
  modified_base (19)..(19): cm
  misc_feature (20)..(20): t is 2prime - deoxy - thymidine - 5prime - phosphorothioate
cccugcuguccacagugactt

SEQ ID NO: 1378 - DNA, 21 bp, Artificial sequence
  Synthetic sequence: human-rat cross-reactive siRNA
  modified_base (3)..(3): cm
  modified_base (12)..(12): cm
  modified_base (15)..(15): cm
  misc_feature (20)..(20): t is 2prime - deoxy - thymidine - 5prime - phosphorothioate
gucacuguggacagcagggtt

SEQ ID NO: 1379 - DNA, 21 bp, Artificial sequence
  Synthetic sequence: human-rat cross-reactive siRNA
  modified_base (2)..(2): cm
  modified_base (5)..(6): cm
  modified_base (9)..(9): um
  modified_base (14)..(15): cm
  modified_base (16)..(16): um
  modified_base (18)..(18): um
  misc_feature (20)..(20): t is 2prime - deoxy - thymidine - 5prime - phosphorothioate
gcagccaguggagccugugtt

SEQ ID NO: 1380 - DNA, 21 bp, Artificial sequence
  Synthetic sequence: human-rat cross-reactive siRNA
  modified_base (1)..(1): cm
  modified_base (3)..(3): cm
  modified_base (10)..(10): cm
  misc_feature (20)..(20): t is 2prime - deoxy - thymidine - 5prime - phosphorothioate
cacaggcuccacuggcugctt

SEQ ID NO: 1381 - DNA, 21 bp, Artificial sequence
  Synthetic sequence: human-rat cross-reactive siRNA
  modified_base (1)..(2): um
  modified_base (3)..(3): cm
  modified_base (6)..(6): um
  modified_base (9)..(9): cm
  modified_base (15)..(15): cm
  modified_base (18)..(18): cm
  modified_base (19)..(19): um
  misc_feature (20)..(20): t is 2prime - deoxy - thymidine - 5prime - phosphorothioate
uucaaugacaagaacaacutt

SEQ ID NO: 1382 - DNA, 21 bp, Artificial sequence
  Synthetic sequence: human-rat cross-reactive siRNA
  modified_base (13)..(13): cm
  misc_feature (20)..(20): t is 2prime - deoxy - thymidine - 5prime - phosphorothioate
aguuguucuugucauugaatt

SEQ ID NO: 1383 - DNA, 21 bp, Artificial sequence
  Synthetic sequence: human-rat cross-reactive siRNA
  modified_base (1)..(1): cm
  modified_base (2)..(2): um
  modified_base (4)..(5): cm
  modified_base (6)..(8): um
  modified_base (10)..(10): um
  modified_base (14)..(14): um
  modified_base (17)..(17): um
  misc_feature (20)..(20): t is 2prime - deoxy - thymidine - 5prime - phosphorothioate
cugccuuuauggaugauggtt

SEQ ID NO: 1384 - DNA, 21 bp, Artificial sequence
  Synthetic sequence: human-rat cross-reactive siRNA
  modified_base (2)..(2): cm
  modified_base (5)..(5): cm
  modified_base (9)..(9): cm
  modified_base (11)..(11): um
  modified_base (17)..(17): cm
  misc_feature (20)..(20): t is 2prime - deoxy - thymidine - 5prime - phosphorothioate
ccaucauccauaaaggcagtt

SEQ ID NO: 1385 - DNA, 21 bp, Artificial sequence
  Synthetic sequence: human-rat cross-reactive siRNA
  modified_base (3)..(3): um
  modified_base (6)..(6): cm
  modified_base (12)..(12): cm
  modified_base (15)..(15): cm
  modified_base (16)..(16): um
  modified_base (17)..(18): cm
  misc_feature (20)..(20): t is 2prime - deoxy - thymidine - 5prime - phosphorothioate
aaugacaagaacaacuccatt

SEQ ID NO: 1386 - DNA, 21 bp, Artificial sequence
  Synthetic sequence: human-rat cross-reactive siRNA
  modified_base (16)..(16): cm
  misc_feature (20)..(20): t is 2prime - deoxy - thymidine - 5prime - phosphorothioate
uggaguuguucuugucauutt

SEQ ID NO: 1387 - DNA, 21 bp, Artificial sequence
  Synthetic sequence: human-rat cross-reactive siRNA
  modified_base (1)..(1): um
  modified_base (5)..(5): cm
  modified_base (8)..(9): cm
  modified_base (12)..(12): um
  modified_base (17)..(18): cm
  modified_base (19)..(19): um
  misc_feature (20)..(20): t is 2prime - deoxy - thymidine - 5prime - phosphorothioate
ugggcagccaguggagccutt

SEQ ID NO: 1388 - DNA, 21 bp, Artificial sequence
  Synthetic sequence: human-rat cross-reactive siRNA
  modified_base (7)..(7): cm
  modified_base (18)..(18): cm
  misc_feature (20)..(20): t is 2prime - deoxy - thymidine - 5prime - phosphorothioate
aggcuccacuggcugcccatt

SEQ ID NO: 1389 - DNA, 21 bp, Artificial sequence
  Synthetic sequence: human-rat cross-reactive siRNA
  modified_base (1)..(1): cm
  modified_base (2)..(2): um
  modified_base (3)..(4): cm
  modified_base (5)..(5): um
  modified_base (7)..(7): um
  modified_base (8)..(9): cm
  modified_base (12)..(13): cm
  modified_base (14)..(14): um
  modified_base (18)..(18): cm
  misc_feature (20)..(20): t is 2prime - deoxy - thymidine - 5prime - phosphorothioate
cuccuguccaaccugggcatt

SEQ ID NO: 1390 - DNA, 21 bp, Artificial sequence
  Synthetic sequence: human-rat cross-reactive siRNA
  modified_base (5)..(5): cm
  modified_base (14)..(14): cm
  misc_feature (20)..(20): t is 2prime - deoxy - thymidine - 5prime - phosphorothioate
ugcccagguuggacaggagtt

SEQ ID NO: 1391 - DNA, 21 bp, Artificial sequence
  Synthetic sequence: human-rat cross-reactive siRNA
  modified_base (3)..(3): cm
  modified_base (5)..(5): um
  modified_base (11)..(12): cm
  modified_base (13)..(13): um
  modified_base (14)..(15): cm
  modified_base (17)..(17): um
  modified_base (18)..(18): cm
  misc_feature (20)..(20): t is 2prime - deoxy - thymidine - 5prime - phosphorothioate
ggcguggagaccuccaucatt

SEQ ID NO: 1392 - DNA, 21 bp, Artificial sequence
  Synthetic sequence: human-rat cross-reactive siRNA
  modified_base (14)..(14): cm
  misc_feature (20)..(20): t is 2prime - deoxy - thymidine - 5prime - phosphorothioate
ugauggaggucuccacgcctt

SEQ ID NO: 1393 - DNA, 21 bp, Artificial sequence
  Synthetic sequence: human-guinea pig cross-reactive siRNA
  modified_base (3)..(3): um
  modified_base (4)..(4): cm
  modified_base (8)..(8): cm
  modified_base (9)..(9): um
  modified_base (11)..(11): cm
  modified_base (12)..(13): um
  modified_base (14)..(14): cm
  modified_base (15)..(15): um
  modified_base (17)..(18): cm
  misc_feature (20)..(20): t is 2prime - deoxy - thymidine - 5prime - phosphorothioate
aaucggacugcuucuaccatt

SEQ ID NO: 1394 - DNA, 21 bp, Artificial sequence
  Synthetic sequence: human-guinea pig cross-reactive siRNA
  modified_base (4)..(4): um
  modified_base (10)..(10): cm
  misc_feature (20)..(20): t is 2prime - deoxy - thymidine - 5prime - phosphorothioate
ugguagaagcaguccgauutt

SEQ ID NO: 1395 - DNA, 21 bp, Artificial sequence
  Synthetic sequence: human-guinea pig cross-reactive siRNA
  modified_base (2)..(2): um
  modified_base (3)..(3): cm
  modified_base (7)..(7): cm
  modified_base (8)..(8): um
  modified_base (10)..(10): cm
  modified_base (11)..(12): um
  modified_base (13)..(13): cm
  modified_base (14)..(14): um
  modified_base (16)..(17): cm
  misc_feature (20)..(20): t is 2prime - deoxy - thymidine - 5prime - phosphorothioate
aucggacugcuucuaccagtt

SEQ ID NO: 1396 - DNA, 21 bp, Artificial sequence
  Synthetic sequence: human-guinea pig cross-reactive siRNA
  modified_base (5)..(5): um
  modified_base (11)..(11): cm
  misc_feature (20)..(20): t is 2prime - deoxy - thymidine - 5prime - phosphorothioate
cugguagaagcaguccgautt

SEQ ID NO: 1397 - DNA, 21 bp, Artificial sequence
  Synthetic sequence: human-guinea pig cross-reactive siRNA
  modified_base (4)..(4): um
  modified_base (5)..(5): cm
  modified_base (9)..(9): cm
  modified_base (10)..(10): um
  modified_base (12)..(12): cm
  modified_base (13)..(14): um
  modified_base (15)..(15): cm
  modified_base (16)..(16): um
  modified_base (18)..(19): cm
  misc_feature (20)..(20): t is 2prime - deoxy - thymidine - 5prime - phosphorothioate
aaaucggacugcuucuacctt

SEQ ID NO: 1398 - DNA, 21 bp, Artificial sequence
  Synthetic sequence: human-guinea pig cross-reactive siRNA
  modified_base (3)..(3): um
  modified_base (9)..(9): cm
  misc_feature (20)..(20): t is 2prime - deoxy - thymidine - 5prime - phosphorothioate
gguagaagcaguccgauuutt

SEQ ID NO: 1399 - DNA, 21 bp, Artificial sequence
  Synthetic sequence: human-guinea pig cross-reactive siRNA
  modified_base (1)..(1): um
  modified_base (2)..(2): cm
  modified_base (6)..(6): cm
  modified_base (7)..(7): um
  modified_base (9)..(9): cm
  modified_base (10)..(11): um
  modified_base (12)..(12): cm
  modified_base (13)..(13): um
  modified_base (15)..(16): cm
  misc_feature (20)..(20): t is 2prime - deoxy - thymidine - 5prime - phosphorothioate
ucggacugcuucuaccagatt

SEQ ID NO: 1400 - DNA, 21 bp, Artificial sequence
  Synthetic sequence: human-guinea pig cross-reactive siRNA
  modified_base (6)..(6): um
  modified_base (12)..(12): cm
  misc_feature (20)..(20): t is 2prime - deoxy - thymidine - 5prime - phosphorothioate
ucugguagaagcaguccgatt

SEQ ID NO: 1401 - DNA, 21 bp, Artificial sequence
  Synthetic sequence: human-guinea pig cross-reactive siRNA
  modified_base (2)..(3): cm
  modified_base (8)..(8): cm
  modified_base (12)..(12): um
  modified_base (13)..(13): cm
  modified_base (17)..(17): cm
  modified_base (18)..(18): um
  misc_feature (20)..(20): t is 2prime - deoxy - thymidine - 5prime - phosphorothioate
accagaacaaaucggacugtt

SEQ ID NO: 1402 - DNA, 21 bp, Artificial sequence
  Synthetic sequence: human-guinea pig cross-reactive siRNA
  modified_base (1)..(1): cm
  misc_feature (20)..(20): t is 2prime - deoxy - thymidine - 5prime - phosphorothioate
caguccgauuuguucuggutt

SEQ ID NO: 1403 - DNA, 21 bp, Artificial sequence
  Synthetic sequence: human-guinea pig cross-reactive siRNA
  modified_base (1)..(2): cm
  modified_base (7)..(7): cm
  modified_base (11)..(11): um
  modified_base (12)..(12): cm
  modified_base (16)..(16): cm
  modified_base (17)..(17): um
  modified_base (19)..(19): cm
  misc_feature (20)..(20): t is 2prime - deoxy - thymidine - 5prime - phosphorothioate
ccagaacaaaucggacugctt

SEQ ID NO: 1404 - DNA, 21 bp, Artificial sequence
  Synthetic sequence: human-guinea pig cross-reactive siRNA
  modified_base (2)..(2): cm
  misc_feature (20)..(20): t is 2prime - deoxy - thymidine - 5prime - phosphorothioate
gcaguccgauuuguucuggtt

SEQ ID NO: 1405 - DNA, 21 bp, Artificial sequence
  Synthetic sequence: human-guinea pig cross-reactive siRNA
  modified_base (1)..(1): cm
  modified_base (6)..(6): cm
  modified_base (10)..(10): um
  modified_base (11)..(11): cm
  modified_base (15)..(15): cm
  modified_base (16)..(16): um
  modified_base (18)..(18): cm
  modified_base (19)..(19): um
  misc_feature (20)..(20): t is 2prime - deoxy - thymidine - 5prime - phosphorothioate
cagaacaaaucggacugcutt

SEQ ID NO: 1406 - DNA, 21 bp, Artificial sequence
  Synthetic sequence: human-guinea pig cross-reactive siRNA
  modified_base (3)..(3): cm
  misc_feature (20)..(20): t is 2prime - deoxy - thymidine - 5prime - phosphorothioate
agcaguccgauuuguucugtt

SEQ ID NO: 1407 - DNA, 21 bp, Artificial sequence
  Synthetic sequence: human-guinea pig cross-reactive siRNA
  modified_base (1)..(1): cm
  modified_base (2)..(3): um
  modified_base (4)..(4): cm
  modified_base (6)..(7): cm
  modified_base (8)..(8): um
  modified_base (10)..(11): cm
  modified_base (13)..(13): cm
  modified_base (14)..(15): um
  modified_base (16)..(16): cm
  modified_base (19)..(19): cm
  misc_feature (20)..(20): t is 2prime - deoxy - thymidine - 5prime - phosphorothioate
cuucgccugccgcuucaactt

SEQ ID NO: 1408 - DNA, 21 bp, Artificial sequence
  Synthetic sequence: human-guinea pig cross-reactive siRNA
  modified_base (11)..(11): cm
  misc_feature (20)..(20): t is 2prime - deoxy - thymidine - 5prime - phosphorothioate
guugaagcggcaggcgaagtt

SEQ ID NO: 1409 - DNA, 21 bp, Artificial sequence
  Synthetic sequence: human-guinea pig cross-reactive siRNA
  modified_base (1)..(1): um
  modified_base (4)..(4): um
  modified_base (6)..(7): cm
  modified_base (9)..(9): cm
  modified_base (10)..(11): um
  modified_base (12)..(13): cm
  modified_base (15)..(15): cm
  modified_base (16)..(16): um
  modified_base (18)..(18): cm
  misc_feature (20)..(20): t is 2prime - deoxy - thymidine - 5prime - phosphorothioate
ugguaccgcuuccacuacatt

SEQ ID NO: 1410 - DNA, 21 bp, Artificial sequence
  Synthetic sequence: human-guinea pig cross-reactive siRNA
  modified_base (3)..(3): um
  modified_base (15)..(15): um
  modified_base (18)..(18): cm
  misc_feature (20)..(20): t is 2prime - deoxy - thymidine - 5prime - phosphorothioate
uguaguggaagcgguaccatt

SEQ ID NO: 1411 - DNA, 21 bp, Artificial sequence
  Synthetic sequence: human-guinea pig cross-reactive siRNA
  modified_base (2)..(2): um
  modified_base (3)..(3): cm
  modified_base (4)..(5): um
  modified_base (6)..(6): cm
  modified_base (8)..(9): cm
  modified_base (10)..(10): um
  modified_base (12)..(13): cm
  modified_base (15)..(15): cm
  modified_base (16)..(17): um
  modified_base (18)..(18): cm
  misc_feature (20)..(20): t is 2prime - deoxy - thymidine - 5prime - phosphorothioate
aucuucgccugccgcuucatt

SEQ ID NO: 1412 - DNA, 21 bp, Artificial sequence
  Synthetic sequence: human-guinea pig cross-reactive siRNA
  modified_base (9)..(9): cm
  misc_feature (20)..(20): t is 2prime - deoxy - thymidine - 5prime - phosphorothioate
ugaagcggcaggcgaagautt

SEQ ID NO: 1413 - DNA, 21 bp, Artificial sequence
  Synthetic sequence: human-guinea pig cross-reactive siRNA
  modified_base (1)..(2): um
  modified_base (3)..(3): cm
  modified_base (5)..(6): cm
  modified_base (7)..(7): um
  modified_base (9)..(10): cm
  modified_base (12)..(12): cm
  modified_base (13)..(14): um
  modified_base (15)..(15): cm
  modified_base (18)..(19): cm
  misc_feature (20)..(20): t is 2prime - deoxy - thymidine - 5prime - phosphorothioate
uucgccugccgcuucaacctt

SEQ ID NO: 1414 - DNA, 21 bp, Artificial sequence
  Synthetic sequence: human-guinea pig cross-reactive siRNA
  modified_base (12)..(12): cm
  misc_feature (20)..(20): t is 2prime - deoxy - thymidine - 5prime - phosphorothioate
gguugaagcggcaggcgaatt

SEQ ID NO: 1415 - DNA, 21 bp, Artificial sequence
  Synthetic sequence: human-guinea pig cross-reactive siRNA
  modified_base (1)..(1): cm
  modified_base (3)..(5): cm
  modified_base (6)..(6): um
  modified_base (7)..(7): cm
  modified_base (10)..(10): um
  modified_base (11)..(13): cm
  modified_base (14)..(14): um
  modified_base (16)..(16): cm
  misc_feature (20)..(20): t is 2prime - deoxy - thymidine - 5prime - phosphorothioate
cacccucaaucccuacaggtt

SEQ ID NO: 1416 - DNA, 21 bp, Artificial sequence
  Synthetic sequence: human-guinea pig cross-reactive siRNA
  modified_base (5)..(5): um
  misc_feature (20)..(20): t is 2prime - deoxy - thymidine - 5prime - phosphorothioate
ccuguagggauugagggugtt

SEQ ID NO: 1417 - DNA, 21 bp, Artificial sequence
  Synthetic sequence: human-guinea pig cross-reactive siRNA
  modified_base (5)..(5): cm
  modified_base (9)..(9): um
  modified_base (10)..(10): cm
  modified_base (14)..(14): cm
  modified_base (15)..(15): um
  modified_base (17)..(17): cm
  modified_base (18)..(19): um
  misc_feature (20)..(20): t is 2prime - deoxy - thymidine - 5prime - phosphorothioate
agaacaaaucggacugcuutt

SEQ ID NO: 1418 - DNA, 21 bp, Artificial sequence
  Synthetic sequence: human-guinea pig cross-reactive siRNA
  modified_base (4)..(4): cm
  misc_feature (20)..(20): t is 2prime - deoxy - thymidine - 5prime - phosphorothioate
aagcaguccgauuuguucutt

SEQ ID NO: 1419 - DNA, 21 bp, Artificial sequence
  Synthetic sequence: human-guinea pig cross-reactive siRNA
  modified_base (4)..(4): cm
  modified_base (8)..(8): um
  modified_base (9)..(9): cm
  modified_base (13)..(13): cm
  modified_base (14)..(14): um
  modified_base (16)..(16): cm
  modified_base (17)..(18): um
  modified_base (19)..(19): cm
  misc_feature (20)..(20): t is 2prime - deoxy - thymidine - 5prime - phosphorothioate
gaacaaaucggacugcuuctt

SEQ ID NO: 1420 - DNA, 21 bp, Artificial sequence
  Synthetic sequence: human-guinea pig cross-reactive siRNA
  modified_base (5)..(5): cm
  misc_feature (20)..(20): t is 2prime - deoxy - thymidine - 5prime - phosphorothioate
gaagcaguccgauuuguuctt

SEQ ID NO: 1421 - DNA, 21 bp, Artificial sequence
  Synthetic sequence: human-guinea pig cross-reactive siRNA
  modified_base (1)..(1): cm
  modified_base (5)..(5): cm
  modified_base (6)..(6): um
  modified_base (8)..(8): cm
  modified_base (9)..(10): um
  modified_base (11)..(11): cm
  modified_base (12)..(12): um
  modified_base (14)..(15): cm
  modified_base (19)..(19): cm
  misc_feature (20)..(20): t is 2prime - deoxy - thymidine - 5prime - phosphorothioate
cggacugcuucuaccagactt

SEQ ID NO: 1422 - DNA, 21 bp, Artificial sequence
  Synthetic sequence: human-guinea pig cross-reactive siRNA
  modified_base (7)..(7): um
  modified_base (13)..(13): cm
  misc_feature (20)..(20): t is 2prime - deoxy - thymidine - 5prime - phosphorothioate
gucugguagaagcaguccgtt

SEQ ID NO: 1423 - DNA, 21 bp, Artificial sequence
  Synthetic sequence: human-guinea pig cross-reactive siRNA
  modified_base (3)..(4): cm
  modified_base (5)..(5): um
  modified_base (6)..(6): cm
  modified_base (9)..(9): cm
  modified_base (11)..(11): um
  modified_base (12)..(12): cm
  modified_base (15)..(16): cm
  modified_base (17)..(17): um
  modified_base (18)..(18): cm
  misc_feature (20)..(20): t is 2prime - deoxy - thymidine - 5prime - phosphorothioate
agccucaacaucaaccucatt

SEQ ID NO: 1424 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugagguugauguugaggcutt

SEQ ID NO: 1425 - DNA, 21 bp, Artificial sequence
  Synthetic sequence: human-guinea pig cross-reactive siRNA
  modified_base (2)..(3): cm
  modified_base (4)..(4): um
  modified_base (5)..(5): cm
  modified_base (8)..(8): cm
  modified_base (10)..(10): um
  modified_base (11)..(11): cm
  modified_base (14)..(15): cm
  modified_base (16)..(16): um
  modified_base (17)..(17): cm
  misc_feature (20)..(20): t is 2prime - deoxy - thymidine - 5prime - phosphorothioate
gccucaacaucaaccucaatt

SEQ ID NO: 1426 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uugagguugauguugaggctt

SEQ ID NO: 1427 - DNA, 21 bp, Artificial sequence
  Synthetic sequence: human-guinea pig cross-reactive siRNA
  modified_base (2)..(2): um
  modified_base (3)..(3): cm
  modified_base (6)..(7): cm
  modified_base (8)..(8): um
  modified_base (9)..(9): cm
  modified_base (12)..(12): cm
  modified_base (14)..(14): um
  modified_base (15)..(15): cm
  modified_base (18)..(19): cm
  misc_feature (20)..(20): t is 2prime - deoxy - thymidine - 5prime - phosphorothioate
gucagccucaacaucaacctt

SEQ ID NO: 1428 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gguugauguugaggcugactt

SEQ ID NO: 1429 - DNA, 21 bp, Artificial sequence
  Synthetic sequence: human-guinea pig cross-reactive siRNA
  modified_base (1)..(1): um
  modified_base (2)..(2): cm
  modified_base (5)..(6): cm
  modified_base (7)..(7): um
  modified_base (8)..(8): cm
  modified_base (11)..(11): cm
  modified_base (13)..(13): um
  modified_base (14)..(14): cm
  modified_base (17)..(18): cm
  modified_base (19)..(19): um
  misc_feature (20)..(20): t is 2prime - deoxy - thymidine - 5prime - phosphorothioate
ucagccucaacaucaaccutt

SEQ ID NO: 1430 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agguugauguugaggcugatt

SEQ ID NO: 1431 - DNA, 21 bp, Artificial sequence
  Synthetic sequence: human-guinea pig cross-reactive siRNA
  modified_base (1)..(1): cm
  modified_base (4)..(5): cm
  modified_base (6)..(6): um
  modified_base (7)..(7): cm
  modified_base (10)..(10): cm
  modified_base (12)..(12): um
  modified_base (13)..(13): cm
  modified_base (16)..(17): cm
  modified_base (18)..(18): um
  modified_base (19)..(19): cm
  misc_feature (20)..(20): t is 2prime - deoxy - thymidine - 5prime - phosphorothioate
cagccucaacaucaaccuctt

SEQ ID NO: 1432 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gagguugauguugaggcugtt

SEQ ID NO: 1433 - DNA, 21 bp, Artificial sequence
  Synthetic sequence: human-guinea pig cross-reactive siRNA
  modified_base (5)..(5): cm
  modified_base (6)..(6): um
  modified_base (10)..(11): cm
  modified_base (13)..(13): cm
  modified_base (15)..(15): um
  modified_base (16)..(16): cm
  modified_base (18)..(18): cm
  misc_feature (20)..(20): t is 2prime - deoxy - thymidine - 5prime - phosphorothioate
ggagcuggaccgcaucacatt

SEQ ID NO: 1434 - DNA, 21 bp, Artificial sequence
  Synthetic sequence: human-guinea pig cross-reactive siRNA
  modified_base (13)..(13): cm
  misc_feature (20)..(20): t is 2prime - deoxy - thymidine - 5prime - phosphorothioate
ugugaugcgguccagcucctt

SEQ ID NO: 1435 - DNA, 21 bp, Artificial sequence
  Synthetic sequence: human-guinea pig cross-reactive siRNA
  modified_base (2)..(2): um
  modified_base (4)..(5): cm
  modified_base (7)..(7): cm
  modified_base (8)..(9): um
  modified_base (10)..(11): cm
  modified_base (13)..(13): cm
  modified_base (14)..(14): um
  modified_base (16)..(16): cm
  modified_base (18)..(18): um
  modified_base (19)..(19): cm
  misc_feature (20)..(20): t is 2prime - deoxy - thymidine - 5prime - phosphorothioate
guaccgcuuccacuacauctt

SEQ ID NO: 1436 - DNA, 21 bp, Artificial sequence
  Synthetic sequence: human-guinea pig cross-reactive siRNA
  modified_base (5)..(5): um
  modified_base (17)..(17): um
  misc_feature (20)..(20): t is 2prime - deoxy - thymidine - 5prime - phosphorothioate
gauguaguggaagcgguactt

SEQ ID NO: 1437 - DNA, 21 bp, Artificial sequence
  Synthetic sequence: human-guinea pig cross-reactive siRNA
  modified_base (1)..(2): cm
  modified_base (4)..(4): cm
  modified_base (5)..(6): um
  modified_base (7)..(8): cm
  modified_base (10)..(10): cm
  modified_base (11)..(11): um
  modified_base (13)..(13): cm
  modified_base (15)..(15): um
  modified_base (16)..(16): cm
  modified_base (19)..(19): cm
  misc_feature (20)..(20): t is 2prime - deoxy - thymidine - 5prime - phosphorothioate
ccgcuuccacuacaucaactt

SEQ ID NO: 1438 - DNA, 21 bp, Artificial sequence
  Synthetic sequence: human-guinea pig cross-reactive siRNA
  modified_base (8)..(8): um
  misc_feature (20)..(20): t is 2prime - deoxy - thymidine - 5prime - phosphorothioate
guugauguaguggaagcggtt

SEQ ID NO: 1439 - DNA, 21 bp, Artificial sequence
  Synthetic sequence: human-guinea pig cross-reactive siRNA
  modified_base (1)..(1): cm
  modified_base (3)..(3): cm
  modified_base (4)..(5): um
  modified_base (6)..(7): cm
  modified_base (9)..(9): cm
  modified_base (10)..(10): um
  modified_base (12)..(12): cm
  modified_base (14)..(14): um
  modified_base (15)..(15): cm
  modified_base (18)..(18): cm
  misc_feature (20)..(20): t is 2prime - deoxy - thymidine - 5prime - phosphorothioate
cgcuuccacuacaucaacatt

SEQ ID NO: 1440 - DNA, 21 bp, Artificial sequence
  Synthetic sequence: human-guinea pig cross-reactive siRNA
  modified_base (9)..(9): um
  misc_feature (20)..(20): t is 2prime - deoxy - thymidine - 5prime - phosphorothioate
uguugauguaguggaagcgtt

SEQ ID NO: 1441 - DNA, 21 bp, Artificial sequence
  Synthetic sequence: human-guinea pig cross-reactive siRNA
  modified_base (1)..(2): um
  modified_base (3)..(4): cm
  modified_base (6)..(6): cm
  modified_base (7)..(7): um
  modified_base (9)..(9): cm
  modified_base (11)..(11): um
  modified_base (12)..(12): cm
  modified_base (15)..(15): cm
  modified_base (17)..(17): um
  modified_base (18)..(19): cm
  misc_feature (20)..(20): t is 2prime - deoxy - thymidine - 5prime - phosphorothioate
uuccacuacaucaacaucctt

SEQ ID NO: 1442 - DNA, 21 bp, Artificial sequence
  Synthetic sequence: human-guinea pig cross-reactive siRNA
  modified_base (12)..(12): um
  misc_feature (20)..(20): t is 2prime - deoxy - thymidine - 5prime - phosphorothioate
ggauguugauguaguggaatt

SEQ ID NO: 1443 - DNA, 21 bp, Artificial sequence
  Synthetic sequence: human-guinea pig cross-reactive siRNA
  modified_base (1)..(1): um
  modified_base (5)..(5): cm
  modified_base (8)..(8): cm
  modified_base (9)..(10): um
  modified_base (11)..(11): cm
  modified_base (13)..(13): um
  modified_base (14)..(14): cm
  modified_base (15)..(16): um
  modified_base (17)..(17): cm
  modified_base (19)..(19): cm
  misc_feature (20)..(20): t is 2prime - deoxy - thymidine - 5prime - phosphorothioate
ugggcaacuucaucuucgctt

SEQ ID NO: 1444 - DNA, 21 bp, Artificial sequence
  Synthetic sequence: human-guinea pig cross-reactive siRNA
  modified_base (18)..(18): cm
  misc_feature (20)..(20): t is 2prime - deoxy - thymidine - 5prime - phosphorothioate
gcgaagaugaaguugcccatt

SEQ ID NO: 1445 - DNA, 21 bp, Artificial sequence
  Synthetic sequence: human-guinea pig cross-reactive siRNA
  modified_base (2)..(2): cm
  modified_base (5)..(5): cm
  modified_base (6)..(7): um
  modified_base (8)..(8): cm
  modified_base (10)..(10): um
  modified_base (11)..(11): cm
  modified_base (12)..(13): um
  modified_base (14)..(14): cm
  modified_base (16)..(17): cm
  modified_base (18)..(18): um
  misc_feature (20)..(20): t is 2prime - deoxy - thymidine - 5prime - phosphorothioate
gcaacuucaucuucgccugtt

SEQ ID NO: 1446 - DNA, 21 bp, Artificial sequence
  Synthetic sequence: human-guinea pig cross-reactive siRNA
  modified_base (1)..(1): cm
  misc_feature (20)..(20): t is 2prime - deoxy - thymidine - 5prime - phosphorothioate
caggcgaagaugaaguugctt

SEQ ID NO: 1447 - DNA, 21 bp, Artificial sequence
  Synthetic sequence: human-guinea pig cross-reactive siRNA
  modified_base (1)..(1): cm
  modified_base (4)..(4): cm
  modified_base (5)..(6): um
  modified_base (7)..(7): cm
  modified_base (9)..(9): um
  modified_base (10)..(10): cm
  modified_base (11)..(12): um
  modified_base (13)..(13): cm
  modified_base (15)..(16): cm
  modified_base (17)..(17): um
  modified_base (19)..(19): cm
  misc_feature (20)..(20): t is 2prime - deoxy - thymidine - 5prime - phosphorothioate
caacuucaucuucgccugctt

SEQ ID NO: 1448 - DNA, 21 bp, Artificial sequence
  Synthetic sequence: human-guinea pig cross-reactive siRNA
  modified_base (2)..(2): cm
  misc_feature (20)..(20): t is 2prime - deoxy - thymidine - 5prime - phosphorothioate
gcaggcgaagaugaaguugtt

SEQ ID NO: 1449 - DNA, 21 bp, Artificial sequence
  Synthetic sequence: human-guinea pig cross-reactive siRNA
  modified_base (3)..(3): cm
  modified_base (4)..(5): um
  modified_base (6)..(6): cm
  modified_base (8)..(8): um
  modified_base (9)..(9): cm
  modified_base (10)..(11): um
  modified_base (12)..(12): cm
  modified_base (14)..(15): cm
  modified_base (16)..(16): um
  modified_base (18)..(19): cm
  misc_feature (20)..(20): t is 2prime - deoxy - thymidine - 5prime - phosphorothioate
aacuucaucuucgccugcctt

SEQ ID NO: 1450 - DNA, 21 bp, Artificial sequence
  Synthetic sequence: human-guinea pig cross-reactive siRNA
  modified_base (3)..(3): cm
  misc_feature (20)..(20): t is 2prime - deoxy - thymidine - 5prime - phosphorothioate
ggcaggcgaagaugaaguutt

SEQ ID NO: 1451 - DNA, 21 bp, Artificial sequence
  Synthetic sequence: human-guinea pig cross-reactive siRNA
  modified_base (2)..(2): cm
  modified_base (3)..(4): um
  modified_base (5)..(5): cm
  modified_base (7)..(7): um
  modified_base (8)..(8): cm
  modified_base (9)..(10): um
  modified_base (11)..(11): cm
  modified_base (13)..(14): cm
  modified_base (15)..(15): um
  modified_base (17)..(18): cm
  misc_feature (20)..(20): t is 2prime - deoxy - thymidine - 5prime - phosphorothioate
acuucaucuucgccugccgtt

SEQ ID NO: 1452 - DNA, 21 bp, Artificial sequence
  Synthetic sequence: human-guinea pig cross-reactive siRNA
  modified_base (4)..(4): cm
  misc_feature (20)..(20): t is 2prime - deoxy - thymidine - 5prime - phosphorothioate
cggcaggcgaagaugaagutt

SEQ ID NO: 1453 - DNA, 21 bp, Artificial sequence
  Synthetic sequence: human-guinea pig cross-reactive siRNA
  modified_base (1)..(1): cm
  modified_base (2)..(3): um
  modified_base (4)..(4): cm
  modified_base (6)..(6): um
  modified_base (7)..(7): cm
  modified_base (8)..(9): um
  modified_base (10)..(10): cm
  modified_base (12)..(13): cm
  modified_base (14)..(14): um
  modified_base (16)..(17): cm
  modified_base (19)..(19): cm
  misc_feature (20)..(20): t is 2prime - deoxy - thymidine - 5prime - phosphorothioate
cuucaucuucgccugccgctt

SEQ ID NO: 1454 - DNA, 21 bp, Artificial sequence
  Synthetic sequence: human-guinea pig cross-reactive siRNA
  modified_base (5)..(5): cm
  misc_feature (20)..(20): t is 2prime - deoxy - thymidine - 5prime - phosphorothioate
gcggcaggcgaagaugaagtt

SEQ ID NO: 1455 - DNA, 21 bp, Artificial sequence
  Synthetic sequence: human-guinea pig cross-reactive siRNA
  modified_base (1)..(1): um
  modified_base (2)..(2): cm
  modified_base (4)..(4): um
  modified_base (5)..(5): cm
  modified_base (6)..(7): um
  modified_base (8)..(8): cm
  modified_base (10)..(11): cm
  modified_base (12)..(12): um
  modified_base (14)..(15): cm
  modified_base (17)..(17): cm
  modified_base (18)..(19): um
  misc_feature (20)..(20): t is 2prime - deoxy - thymidine - 5prime - phosphorothioate
ucaucuucgccugccgcuutt

SEQ ID NO: 1456 - DNA, 21 bp, Artificial sequence
  Synthetic sequence: human-guinea pig cross-reactive siRNA
  modified_base (7)..(7): cm
  misc_feature (20)..(20): t is 2prime - deoxy - thymidine - 5prime - phosphorothioate
aagcggcaggcgaagaugatt

SEQ ID NO: 1457 - DNA, 21 bp, Artificial sequence
  Synthetic sequence: human-guinea pig cross-reactive siRNA
  modified_base (1)..(1): cm
  modified_base (3)..(3): um
  modified_base (4)..(4): cm
  modified_base (5)..(6): um
  modified_base (7)..(7): cm
  modified_base (9)..(10): cm
  modified_base (11)..(11): um
  modified_base (13)..(14): cm
  modified_base (16)..(16): cm
  modified_base (17)..(18): um
  modified_base (19)..(19): cm
  misc_feature (20)..(20): t is 2prime - deoxy - thymidine - 5prime - phosphorothioate
caucuucgccugccgcuuctt

SEQ ID NO: 1458 - DNA, 21 bp, Artificial sequence
  Synthetic sequence: human-guinea pig cross-reactive siRNA
  modified_base (8)..(8): cm
  misc_feature (20)..(20): t is 2prime - deoxy - thymidine - 5prime - phosphorothioate
gaagcggcaggcgaagaugtt

SEQ ID NO: 1459 - DNA, 21 bp, Artificial sequence
  Synthetic sequence: human-guinea pig cross-reactive siRNA
  modified_base (1)..(1): um
  modified_base (2)..(2): cm
  modified_base (3)..(4): um
  modified_base (5)..(5): cm
  modified_base (7)..(8): cm
  modified_base (9)..(9): um
  modified_base (11)..(12): cm
  modified_base (14)..(14): cm
  modified_base (15)..(16): um
  modified_base (17)..(17): cm
  misc_feature (20)..(20): t is 2prime - deoxy - thymidine - 5prime - phosphorothioate
ucuucgccugccgcuucaatt

SEQ ID NO: 1460 - DNA, 21 bp, Artificial sequence
  Synthetic sequence: human-guinea pig cross-reactive siRNA
  modified_base (10)..(10): cm
  misc_feature (20)..(20): t is 2prime - deoxy - thymidine - 5prime - phosphorothioate
uugaagcggcaggcgaagatt

SEQ ID NO: 1461 - DNA, 21 bp, Artificial sequence
  Synthetic sequence: human-guinea pig cross-reactive siRNA
  modified_base (1)..(1): cm
  modified_base (3)..(4): cm
  modified_base (5)..(5): um
  modified_base (7)..(8): cm
  modified_base (10)..(10): cm
  modified_base (11)..(12): um
  modified_base (13)..(13): cm
  modified_base (16)..(17): cm
  misc_feature (20)..(20): t is 2prime - deoxy - thymidine - 5prime - phosphorothioate
cgccugccgcuucaaccagtt

SEQ ID NO: 1462 - DNA, 21 bp, Artificial sequence
  Synthetic sequence: human-guinea pig cross-reactive siRNA
  modified_base (14)..(14): cm
  misc_feature (20)..(20): t is 2prime - deoxy - thymidine - 5prime - phosphorothioate
cugguugaagcggcaggcgtt

SEQ ID NO: 1463 - DNA, 21 bp, Artificial sequence
  Synthetic sequence: human-guinea pig cross-reactive siRNA
  modified_base (2)..(3): cm
  modified_base (4)..(4): um
  modified_base (6)..(7): cm
  modified_base (9)..(9): cm
  modified_base (10)..(11): um
  modified_base (12)..(12): cm
  modified_base (15)..(16): cm
  misc_feature (20)..(20): t is 2prime - deoxy - thymidine - 5prime - phosphorothioate
gccugccgcuucaaccaggtt

SEQ ID NO: 1464 - DNA, 21 bp, Artificial sequence
  Synthetic sequence: human-guinea pig cross-reactive siRNA
  modified_base (15)..(15): cm
  misc_feature (20)..(20): t is 2prime - deoxy - thymidine - 5prime - phosphorothioate
ccugguugaagcggcaggctt

SEQ ID NO: 1465 - DNA, 21 bp, Artificial sequence
  Synthetic sequence: human-guinea pig cross-reactive siRNA
  modified_base (2)..(3): um
  modified_base (5)..(5): cm
  modified_base (6)..(6): um
  modified_base (7)..(7): cm
  modified_base (8)..(8): um
  modified_base (9)..(9): cm
  modified_base (11)..(11): cm
  modified_base (12)..(13): um
  modified_base (14)..(15): cm
  modified_base (17)..(18): cm
  misc_feature (20)..(20): t is 2prime - deoxy - thymidine - 5prime - phosphorothioate
auuacucucacuuccaccatt

SEQ ID NO: 1466 - DNA, 21 bp, Artificial sequence
  Synthetic sequence: human-guinea pig cross-reactive siRNA
  modified_base (16)..(16): um
  misc_feature (20)..(20): t is 2prime - deoxy - thymidine - 5prime - phosphorothioate
ugguggaagugagaguaautt

SEQ ID NO: 1467 - DNA, 21 bp, Artificial sequence
  Synthetic sequence: human-guinea pig cross-reactive siRNA
  modified_base (1)..(2): um
  modified_base (4)..(4): cm
  modified_base (5)..(5): um
  modified_base (6)..(6): cm
  modified_base (7)..(7): um
  modified_base (8)..(8): cm
  modified_base (10)..(10): cm
  modified_base (11)..(12): um
  modified_base (13)..(14): cm
  modified_base (16)..(17): cm
  modified_base (19)..(19): cm
  misc_feature (20)..(20): t is 2prime - deoxy - thymidine - 5prime - phosphorothioate
uuacucucacuuccaccactt

SEQ ID NO: 1468 - DNA, 21 bp, Artificial sequence
  Synthetic sequence: human-guinea pig cross-reactive siRNA
  modified_base (17)..(17): um
  misc_feature (20)..(20): t is 2prime - deoxy - thymidine - 5prime - phosphorothioate
gugguggaagugagaguaatt

SEQ ID NO: 1469 - DNA, 21 bp, Artificial sequence
  Synthetic sequence: human-guinea pig cross-reactive siRNA
  modified_base (2)..(2): cm
  modified_base (3)..(3): um
  modified_base (4)..(4): cm
  modified_base (5)..(5): um
  modified_base (6)..(6): cm
  modified_base (8)..(8): cm
  modified_base (9)..(10): um
  modified_base (11)..(12): cm
  modified_base (14)..(15): cm
  modified_base (17)..(19): cm
  misc_feature (20)..(20): t is 2prime - deoxy - thymidine - 5prime - phosphorothioate
acucucacuuccaccaccctt

SEQ ID NO: 1470 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gggugguggaagugagagutt

SEQ ID NO: 1471 - DNA, 21 bp, Artificial sequence
  Synthetic sequence: human-guinea pig cross-reactive siRNA
  modified_base (1)..(1): um
  modified_base (2)..(2): cm
  modified_base (3)..(3): um
  modified_base (5)..(5): cm
  modified_base (7)..(9): cm
  modified_base (10)..(10): um
  modified_base (11)..(11): cm
  modified_base (14)..(14): um
  modified_base (15)..(17): cm
  modified_base (18)..(18): um
  misc_feature (20)..(20): t is 2prime - deoxy - thymidine - 5prime - phosphorothioate
ucugcacccucaaucccuatt

SEQ ID NO: 1472 - DNA, 21 bp, Artificial sequence
  Synthetic sequence: human-guinea pig cross-reactive siRNA
  modified_base (1)..(1): um
  modified_base (16)..(16): cm
  misc_feature (20)..(20): t is 2prime - deoxy - thymidine - 5prime - phosphorothioate
uagggauugagggugcagatt

SEQ ID NO: 1473 - DNA, 21 bp, Artificial sequence
  Synthetic sequence: human-guinea pig cross-reactive siRNA
  modified_base (1)..(1): cm
  modified_base (2)..(2): um
  modified_base (4)..(4): cm
  modified_base (6)..(8): cm
  modified_base (9)..(9): um
  modified_base (10)..(10): cm
  modified_base (13)..(13): um
  modified_base (14)..(16): cm
  modified_base (17)..(17): um
  modified_base (19)..(19): cm
  misc_feature (20)..(20): t is 2prime - deoxy - thymidine - 5prime - phosphorothioate
cugcacccucaaucccuactt

SEQ ID NO: 1474 - DNA, 21 bp, Artificial sequence
  Synthetic sequence: human-guinea pig cross-reactive siRNA
  modified_base (2)..(2): um
  modified_base (17)..(17): cm
  misc_feature (20)..(20): t is 2prime - deoxy - thymidine - 5prime - phosphorothioate
guagggauugagggugcagtt

SEQ ID NO: 1475 - DNA, 21 bp, Artificial sequence
  Synthetic sequence: human-guinea pig cross-reactive siRNA
  modified_base (1)..(1): um
  modified_base (3)..(3): cm
  modified_base (5)..(7): cm
  modified_base (8)..(8): um
  modified_base (9)..(9): cm
  modified_base (12)..(12): um
  modified_base (13)..(15): cm
  modified_base (16)..(16): um
  modified_base (18)..(18): cm
  misc_feature (20)..(20): t is 2prime - deoxy - thymidine - 5prime - phosphorothioate
ugcacccucaaucccuacatt

SEQ ID NO: 1476 - DNA, 21 bp, Artificial sequence
  Synthetic sequence: human-guinea pig cross-reactive siRNA
  modified_base (3)..(3): um
  modified_base (18)..(18): cm
  misc_feature (20)..(20): t is 2prime - deoxy - thymidine - 5prime - phosphorothioate
uguagggauugagggugcatt

SEQ ID NO: 1477 - DNA, 21 bp, Artificial sequence
  Synthetic sequence: human-guinea pig cross-reactive siRNA
  modified_base (2)..(4): cm
  modified_base (5)..(5): um
  modified_base (6)..(6): cm
  modified_base (9)..(9): um
  modified_base (10)..(12): cm
  modified_base (13)..(13): um
  modified_base (15)..(15): cm
  modified_base (19)..(19): um
  misc_feature (20)..(20): t is 2prime - deoxy - thymidine - 5prime - phosphorothioate
acccucaaucccuacaggutt

SEQ ID NO: 1478 - DNA, 21 bp, Artificial sequence
  Synthetic sequence: human-guinea pig cross-reactive siRNA
  modified_base (6)..(6): um
  misc_feature (20)..(20): t is 2prime - deoxy - thymidine - 5prime - phosphorothioate
accuguagggauugagggutt

SEQ ID NO: 1479 - DNA, 21 bp, Artificial sequence
  Synthetic sequence: human-guinea pig cross-reactive siRNA
  modified_base (1)..(3): cm
  modified_base (4)..(4): um
  modified_base (5)..(5): cm
  modified_base (8)..(8): um
  modified_base (9)..(11): cm
  modified_base (12)..(12): um
  modified_base (14)..(14): cm
  modified_base (18)..(18): um
  misc_feature (20)..(20): t is 2prime - deoxy - thymidine - 5prime - phosphorothioate
cccucaaucccuacagguatt

SEQ ID NO: 1480 - DNA, 21 bp, Artificial sequence
  Synthetic sequence: human-guinea pig cross-reactive siRNA
  modified_base (1)..(1): um
  modified_base (7)..(7): um
  misc_feature (20)..(20): t is 2prime - deoxy - thymidine - 5prime - phosphorothioate
uaccuguagggauugagggtt

SEQ ID NO: 1481 - DNA, 21 bp, Artificial sequence
  Synthetic sequence: human-guinea pig cross-reactive siRNA
  modified_base (1)..(2): cm
  modified_base (3)..(3): um
  modified_base (4)..(4): cm
  modified_base (7)..(7): um
  modified_base (8)..(10): cm
  modified_base (11)..(11): um
  modified_base (13)..(13): cm
  modified_base (17)..(17): um
  modified_base (19)..(19): cm
  misc_feature (20)..(20): t is 2prime - deoxy - thymidine - 5prime - phosphorothioate
ccucaaucccuacagguactt

SEQ ID NO: 1482 - DNA, 21 bp, Artificial sequence
  Synthetic sequence: human-guinea pig cross-reactive siRNA
  modified_base (2)..(2): um
  modified_base (8)..(8): um
  misc_feature (20)..(20): t is 2prime - deoxy - thymidine - 5prime - phosphorothioate
guaccuguagggauugaggtt

SEQ ID NO: 1483 - DNA, 21 bp, Artificial sequence
  Synthetic sequence: human-guinea pig cross-reactive siRNA
  modified_base (3)..(4): cm
  modified_base (9)..(9): cm
  modified_base (13)..(13): um
  modified_base (14)..(14): cm
  modified_base (18)..(18): cm
  modified_base (19)..(19): um
  misc_feature (20)..(20): t is 2prime - deoxy - thymidine - 5prime - phosphorothioate
aaccagaacaaaucggacutt

SEQ ID NO: 1484 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aguccgauuuguucugguutt

SEQ ID NO: 1485 - DNA, 21 bp, Artificial sequence
  Synthetic sequence: human-guinea pig cross-reactive siRNA
  modified_base (3)..(3): cm
  modified_base (7)..(7): um
  modified_base (8)..(8): cm
  modified_base (12)..(12): cm
  modified_base (13)..(13): um
  modified_base (15)..(15): cm
  modified_base (16)..(17): um
  modified_base (18)..(18): cm
  modified_base (19)..(19): um
  misc_feature (20)..(20): t is 2prime - deoxy - thymidine - 5prime - phosphorothioate
aacaaaucggacugcuucutt

SEQ ID NO: 1486 - DNA, 21 bp, Artificial sequence
  Synthetic sequence: human-guinea pig cross-reactive siRNA
  modified_base (6)..(6): cm
  misc_feature (20)..(20): t is 2prime - deoxy - thymidine - 5prime - phosphorothioate
agaagcaguccgauuuguutt

SEQ ID NO: 1487 - DNA, 21 bp, Artificial sequence
  Synthetic sequence: human-guinea pig cross-reactive siRNA
  modified_base (2)..(2): cm
  modified_base (6)..(6): um
  modified_base (7)..(7): cm
  modified_base (11)..(11): cm
  modified_base (12)..(12): um
  modified_base (14)..(14): cm
  modified_base (15)..(16): um
  modified_base (17)..(17): cm
  modified_base (18)..(18): um
  misc_feature (20)..(20): t is 2prime - deoxy - thymidine - 5prime - phosphorothioate
acaaaucggacugcuucuatt

SEQ ID NO: 1488 - DNA, 21 bp, Artificial sequence
  Synthetic sequence: human-guinea pig cross-reactive siRNA
  modified_base (1)..(1): um
  modified_base (7)..(7): cm
  misc_feature (20)..(20): t is 2prime - deoxy - thymidine - 5prime - phosphorothioate
uagaagcaguccgauuugutt

SEQ ID NO: 1489 - DNA, 21 bp, Artificial sequence
  Synthetic sequence: human-guinea pig cross-reactive siRNA
  modified_base (1)..(1): cm
  modified_base (5)..(5): um
  modified_base (6)..(6): cm
  modified_base (10)..(10): cm
  modified_base (11)..(11): um
  modified_base (13)..(13): cm
  modified_base (14)..(15): um
  modified_base (16)..(16): cm
  modified_base (17)..(17): um
  modified_base (19)..(19): cm
  misc_feature (20)..(20): t is 2prime - deoxy - thymidine - 5prime - phosphorothioate
caaaucggacugcuucuactt

SEQ ID NO: 1490 - DNA, 21 bp, Artificial sequence
  Synthetic sequence: human-guinea pig cross-reactive siRNA
  modified_base (2)..(2): um
  modified_base (8)..(8): cm
  misc_feature (20)..(20): t is 2prime - deoxy - thymidine - 5prime - phosphorothioate
guagaagcaguccgauuugtt

SEQ ID NO: 1491 - DNA, 21 bp, Artificial sequence
  Synthetic sequence: human-guinea pig cross-reactive siRNA
  modified_base (2)..(2): cm
  modified_base (4)..(6): cm
  modified_base (7)..(7): um
  modified_base (8)..(8): cm
  modified_base (11)..(11): um
  modified_base (12)..(14): cm
  modified_base (15)..(15): um
  modified_base (17)..(17): cm
  misc_feature (20)..(20): t is 2prime - deoxy - thymidine - 5prime - phosphorothioate
gcacccucaaucccuacagtt

SEQ ID NO: 1492 - DNA, 21 bp, Artificial sequence
  Synthetic sequence: human-guinea pig cross-reactive siRNA
  modified_base (4)..(4): um
  misc_feature (20)..(20): t is 2prime - deoxy - thymidine - 5prime - phosphorothioate
cuguagggauugagggugctt

SEQ ID NO: 1493 - DNA, 21 bp, Artificial sequence
  Synthetic sequence: human-guinea pig cross-reactive siRNA
  modified_base (1)..(2): cm
  modified_base (3)..(3): um
  modified_base (4)..(4): cm
  modified_base (7)..(7): cm
  modified_base (9)..(9): um
  modified_base (10)..(10): cm
  modified_base (13)..(14): cm
  modified_base (15)..(15): um
  modified_base (16)..(16): cm
  modified_base (19)..(19): cm
  misc_feature (20)..(20): t is 2prime - deoxy - thymidine - 5prime - phosphorothioate
ccucaacaucaaccucaactt

SEQ ID NO: 1494 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guugagguugauguugaggtt

SEQ ID NO: 1495 - DNA, 21 bp, Artificial sequence
  Synthetic sequence: human-guinea pig cross-reactive siRNA
  modified_base (1)..(1): cm
  modified_base (2)..(2): um
  modified_base (3)..(3): cm
  modified_base (6)..(6): cm
  modified_base (8)..(8): um
  modified_base (9)..(9): cm
  modified_base (12)..(13): cm
  modified_base (14)..(14): um
  modified_base (15)..(15): cm
  modified_base (18)..(18): cm
  modified_base (19)..(19): um
  misc_feature (20)..(20): t is 2prime - deoxy - thymidine - 5prime - phosphorothioate
cucaacaucaaccucaacutt

SEQ ID NO: 1496 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aguugagguugauguugagtt

SEQ ID NO: 1497 - DNA, 21 bp, Artificial sequence
  Synthetic sequence: human-guinea pig cross-reactive siRNA
  modified_base (1)..(1): um
  modified_base (2)..(2): cm
  modified_base (5)..(5): cm
  modified_base (7)..(7): um
  modified_base (8)..(8): cm
  modified_base (11)..(12): cm
  modified_base (13)..(13): um
  modified_base (14)..(14): cm
  modified_base (17)..(17): cm
  modified_base (18)..(18): um
  modified_base (19)..(19): cm
  misc_feature (20)..(20): t is 2prime - deoxy - thymidine - 5prime - phosphorothioate
ucaacaucaaccucaacuctt

SEQ ID NO: 1498 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gaguugagguugauguugatt

SEQ ID NO: 1499 - DNA, 21 bp, Artificial sequence
  Synthetic sequence: human-guinea pig cross-reactive siRNA
  modified_base (1)..(1): um
  modified_base (3)..(4): cm
  modified_base (6)..(6): cm
  modified_base (7)..(8): um
  modified_base (9)..(10): cm
  modified_base (12)..(12): cm
  modified_base (13)..(13): um
  modified_base (15)..(15): cm
  modified_base (17)..(17): um
  modified_base (18)..(18): cm
  misc_feature (20)..(20): t is 2prime - deoxy - thymidine - 5prime - phosphorothioate
uaccgcuuccacuacaucatt

SEQ ID NO: 1500 - DNA, 21 bp, Artificial sequence
  Synthetic sequence: human-guinea pig cross-reactive siRNA
  modified_base (6)..(6): um
  modified_base (18)..(18): um
  misc_feature (20)..(20): t is 2prime - deoxy - thymidine - 5prime - phosphorothioate
ugauguaguggaagcgguatt

SEQ ID NO: 1501 - DNA, 21 bp, Artificial sequence
  Synthetic sequence: human-guinea pig cross-reactive siRNA
  modified_base (2)..(3): cm
  modified_base (5)..(5): cm
  modified_base (6)..(7): um
  modified_base (8)..(9): cm
  modified_base (11)..(11): cm
  modified_base (12)..(12): um
  modified_base (14)..(14): cm
  modified_base (16)..(16): um
  modified_base (17)..(17): cm
  misc_feature (20)..(20): t is 2prime - deoxy - thymidine - 5prime - phosphorothioate
accgcuuccacuacaucaatt

SEQ ID NO: 1502 - DNA, 21 bp, Artificial sequence
  Synthetic sequence: human-guinea pig cross-reactive siRNA
  modified_base (7)..(7): um
  misc_feature (20)..(20): t is 2prime - deoxy - thymidine - 5prime - phosphorothioate
uugauguaguggaagcggutt

SEQ ID NO: 1503 - DNA, 21 bp, Artificial sequence
  Synthetic sequence: human-guinea pig cross-reactive siRNA
  modified_base (2)..(2): cm
  modified_base (3)..(4): um
  modified_base (5)..(6): cm
  modified_base (8)..(8): cm
  modified_base (9)..(9): um
  modified_base (11)..(11): cm
  modified_base (13)..(13): um
  modified_base (14)..(14): cm
  modified_base (17)..(17): cm
  modified_base (19)..(19): um
  misc_feature (20)..(20): t is 2prime - deoxy - thymidine - 5prime - phosphorothioate
gcuuccacuacaucaacautt

SEQ ID NO: 1504 - DNA, 21 bp, Artificial sequence
  Synthetic sequence: human-guinea pig cross-reactive siRNA
  modified_base (10)..(10): um
  misc_feature (20)..(20): t is 2prime - deoxy - thymidine - 5prime - phosphorothioate
auguugauguaguggaagctt

SEQ ID NO: 1505 - DNA, 21 bp, Artificial sequence
  Synthetic sequence: human-guinea pig cross-reactive siRNA
  modified_base (1)..(1): cm
  modified_base (2)..(3): um
  modified_base (4)..(5): cm
  modified_base (7)..(7): cm
  modified_base (8)..(8): um
  modified_base (10)..(10): cm
  modified_base (12)..(12): um
  modified_base (13)..(13): cm
  modified_base (16)..(16): cm
  modified_base (18)..(18): um
  modified_base (19)..(19): cm
  misc_feature (20)..(20): t is 2prime - deoxy - thymidine - 5prime - phosphorothioate
cuuccacuacaucaacauctt

SEQ ID NO: 1506 - DNA, 21 bp, Artificial sequence
  Synthetic sequence: human-guinea pig cross-reactive siRNA
  modified_base (11)..(11): um
  misc_feature (20)..(20): t is 2prime - deoxy - thymidine - 5prime - phosphorothioate
gauguugauguaguggaagtt

SEQ ID NO: 1507 - DNA, 21 bp, Artificial sequence
  Synthetic sequence: human-guinea pig cross-reactive siRNA
  modified_base (1)..(1): um
  modified_base (2)..(3): cm
  modified_base (5)..(5): cm
  modified_base (6)..(6): um
  modified_base (8)..(8): cm
  modified_base (10)..(10): um
  modified_base (11)..(11): cm
  modified_base (14)..(14): cm
  modified_base (16)..(16): um
  modified_base (17)..(18): cm
  modified_base (19)..(19): um
  misc_feature (20)..(20): t is 2prime - deoxy - thymidine - 5prime - phosphorothioate
uccacuacaucaacauccutt

SEQ ID NO: 1508 - DNA, 21 bp, Artificial sequence
  Synthetic sequence: human-guinea pig cross-reactive siRNA
  modified_base (13)..(13): um
  misc_feature (20)..(20): t is 2prime - deoxy - thymidine - 5prime - phosphorothioate
aggauguugauguaguggatt

SEQ ID NO: 1509 - DNA, 21 bp, Artificial sequence
  Synthetic sequence: human-guinea pig cross-reactive siRNA
  modified_base (1)..(2): cm
  modified_base (4)..(4): cm
  modified_base (5)..(5): um
  modified_base (7)..(7): cm
  modified_base (9)..(9): um
  modified_base (10)..(10): cm
  modified_base (13)..(13): cm
  modified_base (15)..(15): um
  modified_base (16)..(17): cm
  modified_base (18)..(18): um
  misc_feature (20)..(20): t is 2prime - deoxy - thymidine - 5prime - phosphorothioate
ccacuacaucaacauccugtt

SEQ ID NO: 1510 - DNA, 21 bp, Artificial sequence
  Synthetic sequence: human-guinea pig cross-reactive siRNA
  modified_base (1)..(1): cm
  modified_base (14)..(14): um
  misc_feature (20)..(20): t is 2prime - deoxy - thymidine - 5prime - phosphorothioate
caggauguugauguaguggtt

SEQ ID NO: 1511 - DNA, 21 bp, Artificial sequence
  Synthetic sequence: human-guinea pig cross-reactive siRNA
  modified_base (1)..(1): cm
  modified_base (2)..(2): um
  modified_base (6)..(6): cm
  modified_base (9)..(9): cm
  modified_base (10)..(11): um
  modified_base (12)..(12): cm
  modified_base (14)..(14): um
  modified_base (15)..(15): cm
  modified_base (16)..(17): um
  modified_base (18)..(18): cm
  misc_feature (20)..(20): t is 2prime - deoxy - thymidine - 5prime - phosphorothioate
cugggcaacuucaucuucgtt

SEQ ID NO: 1512 - DNA, 21 bp, Artificial sequence
  Synthetic sequence: human-guinea pig cross-reactive siRNA
  modified_base (17)..(17): cm
  misc_feature (20)..(20): t is 2prime - deoxy - thymidine - 5prime - phosphorothioate
cgaagaugaaguugcccagtt

SEQ ID NO: 1513 - DNA, 21 bp, Artificial sequence
  Synthetic sequence: human-guinea pig cross-reactive siRNA
  modified_base (3)..(3): cm
  modified_base (6)..(6): cm
  modified_base (7)..(8): um
  modified_base (9)..(9): cm
  modified_base (11)..(11): um
  modified_base (12)..(12): cm
  modified_base (13)..(14): um
  modified_base (15)..(15): cm
  modified_base (17)..(18): cm
  modified_base (19)..(19): um
  misc_feature (20)..(20): t is 2prime - deoxy - thymidine - 5prime - phosphorothioate
ggcaacuucaucuucgccutt

SEQ ID NO: 1514 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aggcgaagaugaaguugcctt

SEQ ID NO: 1515 - DNA, 21 bp, Artificial sequence
  Synthetic sequence: human-guinea pig cross-reactive siRNA
  modified_base (1)..(2): um
  modified_base (3)..(3): cm
  modified_base (5)..(5): um
  modified_base (6)..(6): cm
  modified_base (7)..(8): um
  modified_base (9)..(9): cm
  modified_base (11)..(12): cm
  modified_base (13)..(13): um
  modified_base (15)..(16): cm
  modified_base (18)..(18): cm
  modified_base (19)..(19): um
  misc_feature (20)..(20): t is 2prime - deoxy - thymidine - 5prime - phosphorothioate
uucaucuucgccugccgcutt

SEQ ID NO: 1516 - DNA, 21 bp, Artificial sequence
  Synthetic sequence: human-guinea pig cross-reactive siRNA
  modified_base (6)..(6): cm
  misc_feature (20)..(20): t is 2prime - deoxy - thymidine - 5prime - phosphorothioate
agcggcaggcgaagaugaatt

SEQ ID NO: 1517 - DNA, 21 bp, Artificial sequence
  Synthetic sequence: human-guinea pig cross-reactive siRNA
  modified_base (1)..(1): um
  modified_base (2)..(2): cm
  modified_base (4)..(5): cm
  modified_base (6)..(6): um
  modified_base (8)..(9): cm
  modified_base (11)..(11): cm
  modified_base (12)..(13): um
  modified_base (14)..(14): cm
  modified_base (17)..(18): cm
  misc_feature (20)..(20): t is 2prime - deoxy - thymidine - 5prime - phosphorothioate
ucgccugccgcuucaaccatt

SEQ ID NO: 1518 - DNA, 21 bp, Artificial sequence
  Synthetic sequence: human-guinea pig cross-reactive siRNA
  modified_base (13)..(13): cm
  misc_feature (20)..(20): t is 2prime - deoxy - thymidine - 5prime - phosphorothioate
ugguugaagcggcaggcgatt

SEQ ID NO: 1519 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aaucggacugcuucuaccatt

SEQ ID NO: 1520 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugguagaagcaguccgauutt

SEQ ID NO: 1521 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aucggacugcuucuaccagtt

SEQ ID NO: 1522 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cugguagaagcaguccgautt

SEQ ID NO: 1523 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aaaucggacugcuucuacctt

SEQ ID NO: 1524 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gguagaagcaguccgauuutt

SEQ ID NO: 1525 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucggacugcuucuaccagatt

SEQ ID NO: 1526 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucugguagaagcaguccgatt

SEQ ID NO: 1527 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
accagaacaaaucggacugtt

SEQ ID NO: 1528 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caguccgauuuguucuggutt

SEQ ID NO: 1529 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccagaacaaaucggacugctt

SEQ ID NO: 1530 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcaguccgauuuguucuggtt

SEQ ID NO: 1531 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cagaacaaaucggacugcutt

SEQ ID NO: 1532 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agcaguccgauuuguucugtt

SEQ ID NO: 1533 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cuucgccugccgcuucaactt

SEQ ID NO: 1534 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guugaagcggcaggcgaagtt

SEQ ID NO: 1535 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugguaccgcuuccacuacatt

SEQ ID NO: 1536 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uguaguggaagcgguaccatt

SEQ ID NO: 1537 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aucuucgccugccgcuucatt

SEQ ID NO: 1538 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugaagcggcaggcgaagautt

SEQ ID NO: 1539 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uucgccugccgcuucaacctt

SEQ ID NO: 1540 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gguugaagcggcaggcgaatt

SEQ ID NO: 1541 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cacccucaaucccuacaggtt

SEQ ID NO: 1542 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccuguagggauugagggugtt

SEQ ID NO: 1543 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agaacaaaucggacugcuutt

SEQ ID NO: 1544 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aagcaguccgauuuguucutt

SEQ ID NO: 1545 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gaacaaaucggacugcuuctt

SEQ ID NO: 1546 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gaagcaguccgauuuguuctt

SEQ ID NO: 1547 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cggacugcuucuaccagactt

SEQ ID NO: 1548 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gucugguagaagcaguccgtt

SEQ ID NO: 1549 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agccucaacaucaaccucatt

SEQ ID NO: 1550 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugagguugauguugaggcutt

SEQ ID NO: 1551 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gccucaacaucaaccucaatt

SEQ ID NO: 1552 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uugagguugauguugaggctt

SEQ ID NO: 1553 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gucagccucaacaucaacctt

SEQ ID NO: 1554 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gguugauguugaggcugactt

SEQ ID NO: 1555 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucagccucaacaucaaccutt

SEQ ID NO: 1556 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agguugauguugaggcugatt

SEQ ID NO: 1557 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cagccucaacaucaaccuctt

SEQ ID NO: 1558 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gagguugauguugaggcugtt

SEQ ID NO: 1559 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ggagcuggaccgcaucacatt

SEQ ID NO: 1560 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugugaugcgguccagcucctt

SEQ ID NO: 1561 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guaccgcuuccacuacauctt

SEQ ID NO: 1562 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gauguaguggaagcgguactt

SEQ ID NO: 1563 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccgcuuccacuacaucaactt

SEQ ID NO: 1564 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guugauguaguggaagcggtt

SEQ ID NO: 1565 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cgcuuccacuacaucaacatt

SEQ ID NO: 1566 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uguugauguaguggaagcgtt

SEQ ID NO: 1567 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uuccacuacaucaacaucctt

SEQ ID NO: 1568 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ggauguugauguaguggaatt

SEQ ID NO: 1569 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugggcaacuucaucuucgctt

SEQ ID NO: 1570 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcgaagaugaaguugcccatt

SEQ ID NO: 1571 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcaacuucaucuucgccugtt

SEQ ID NO: 1572 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caggcgaagaugaaguugctt

SEQ ID NO: 1573 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caacuucaucuucgccugctt

SEQ ID NO: 1574 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcaggcgaagaugaaguugtt

SEQ ID NO: 1575 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aacuucaucuucgccugcctt

SEQ ID NO: 1576 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ggcaggcgaagaugaaguutt

SEQ ID NO: 1577 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
acuucaucuucgccugccgtt

SEQ ID NO: 1578 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cggcaggcgaagaugaagutt

SEQ ID NO: 1579 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cuucaucuucgccugccgctt

SEQ ID NO: 1580 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcggcaggcgaagaugaagtt

SEQ ID NO: 1581 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucaucuucgccugccgcuutt

SEQ ID NO: 1582 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aagcggcaggcgaagaugatt

SEQ ID NO: 1583 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caucuucgccugccgcuuctt

SEQ ID NO: 1584 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gaagcggcaggcgaagaugtt

SEQ ID NO: 1585 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucuucgccugccgcuucaatt

SEQ ID NO: 1586 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uugaagcggcaggcgaagatt

SEQ ID NO: 1587 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cgccugccgcuucaaccagtt

SEQ ID NO: 1588 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cugguugaagcggcaggcgtt

SEQ ID NO: 1589 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gccugccgcuucaaccaggtt

SEQ ID NO: 1590 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccugguugaagcggcaggctt

SEQ ID NO: 1591 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
auuacucucacuuccaccatt

SEQ ID NO: 1592 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugguggaagugagaguaautt

SEQ ID NO: 1593 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uuacucucacuuccaccactt

SEQ ID NO: 1594 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gugguggaagugagaguaatt

SEQ ID NO: 1595 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
acucucacuuccaccaccctt

SEQ ID NO: 1596 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gggugguggaagugagagutt

SEQ ID NO: 1597 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucugcacccucaaucccuatt

SEQ ID NO: 1598 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uagggauugagggugcagatt

SEQ ID NO: 1599 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cugcacccucaaucccuactt

SEQ ID NO: 1600 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guagggauugagggugcagtt

SEQ ID NO: 1601 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugcacccucaaucccuacatt

SEQ ID NO: 1602 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uguagggauugagggugcatt

SEQ ID NO: 1603 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
acccucaaucccuacaggutt

SEQ ID NO: 1604 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
accuguagggauugagggutt

SEQ ID NO: 1605 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cccucaaucccuacagguatt

SEQ ID NO: 1606 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uaccuguagggauugagggtt

SEQ ID NO: 1607 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccucaaucccuacagguactt

SEQ ID NO: 1608 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guaccuguagggauugaggtt

SEQ ID NO: 1609 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aaccagaacaaaucggacutt

SEQ ID NO: 1610 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aguccgauuuguucugguutt

SEQ ID NO: 1611 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aacaaaucggacugcuucutt

SEQ ID NO: 1612 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agaagcaguccgauuuguutt

SEQ ID NO: 1613 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
acaaaucggacugcuucuatt

SEQ ID NO: 1614 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uagaagcaguccgauuugutt

SEQ ID NO: 1615 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caaaucggacugcuucuactt

SEQ ID NO: 1616 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guagaagcaguccgauuugtt

SEQ ID NO: 1617 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcacccucaaucccuacagtt

SEQ ID NO: 1618 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cuguagggauugagggugctt

SEQ ID NO: 1619 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccucaacaucaaccucaactt

SEQ ID NO: 1620 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
guugagguugauguugaggtt

SEQ ID NO: 1621 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cucaacaucaaccucaacutt

SEQ ID NO: 1622 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aguugagguugauguugagtt

SEQ ID NO: 1623 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucaacaucaaccucaacuctt

SEQ ID NO: 1624 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gaguugagguugauguugatt

SEQ ID NO: 1625 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uaccgcuuccacuacaucatt

SEQ ID NO: 1626 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugauguaguggaagcgguatt

SEQ ID NO: 1627 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
accgcuuccacuacaucaatt

SEQ ID NO: 1628 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uugauguaguggaagcggutt

SEQ ID NO: 1629 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gcuuccacuacaucaacautt

SEQ ID NO: 1630 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
auguugauguaguggaagctt

SEQ ID NO: 1631 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cuuccacuacaucaacauctt

SEQ ID NO: 1632 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
gauguugauguaguggaagtt

SEQ ID NO: 1633 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uccacuacaucaacauccutt

SEQ ID NO: 1634 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aggauguugauguaguggatt

SEQ ID NO: 1635 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ccacuacaucaacauccugtt

SEQ ID NO: 1636 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
caggauguugauguaguggtt

SEQ ID NO: 1637 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cugggcaacuucaucuucgtt

SEQ ID NO: 1638 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
cgaagaugaaguugcccagtt

SEQ ID NO: 1639 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ggcaacuucaucuucgccutt

SEQ ID NO: 1640 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
aggcgaagaugaaguugcctt

SEQ ID NO: 1641 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
uucaucuucgccugccgcutt

SEQ ID NO: 1642 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
agcggcaggcgaagaugaatt

SEQ ID NO: 1643 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ucgccugccgcuucaaccatt

SEQ ID NO: 1644 - DNA, 21 bp, Artificial sequence
  Synthetic sequence: human-guinea pig cross-reactive siRNA
  misc_feature (20)..(20): t is 2prime - deoxy - thymidine - 5prime - phosphorothioate
ugguugaagcggcaggcgatt

SEQ ID NO: 1645 - DNA, 42 bp, Artificial sequence
  Synthetic sequence: Probe specific to human ENaC-alpha
gtctgtccagggtttccttcctttttctcttggaaagaaagt

SEQ ID NO: 1646 - DNA, 41 bp, Artificial sequence
  Synthetic sequence: Probe specific to human ENaC-alpha
actgccattcttggtgcagttttttctcttggaaagaaagt

SEQ ID NO: 1647 - DNA, 45 bp, Artificial sequence
  Synthetic sequence: Probe specific to human ENaC-alpha
ctctcctggaagcaggagtgaatatttttctcttggaaagaaagt

SEQ ID NO: 1648 - DNA, 42 bp, Artificial sequence
  Synthetic sequence: Probe specific to human ENaC-alpha
gccgcggatagaagatgtaggtttttctcttggaaagaaagt

SEQ ID NO: 1649 - DNA, 42 bp, Artificial sequence
  Synthetic sequence: Probe specific to human ENaC-alpha
gcacttggtgaaacagcccagtttttctcttggaaagaaagt

SEQ ID NO: 1650 - DNA, 43 bp, Artificial sequence
  Synthetic sequence: Probe specific to human ENaC-alpha
agcagagagctggtagctggtctttttctcttggaaagaaagt

SEQ ID NO: 1651 - DNA, 42 bp, Artificial sequence
  Synthetic sequence: Probe specific to human ENaC-alpha
cgccataatcgcccccaatttttaggcataggacccgtgtct

SEQ ID NO: 1652 - DNA, 47 bp, Artificial sequence
  Synthetic sequence: Probe specific to human ENaC-alpha
cacagccacactccttgatcatgtttttaggcataggacccgtgtct

SEQ ID NO: 1653 - DNA, 44 bp, Artificial sequence
  Synthetic sequence: Probe specific to human ENaC-alpha
acagtactccacgttctgggtttttaggcataggacccgtgtct

SEQ ID NO: 1654 - DNA, 47 bp, Artificial sequence
  Synthetic sequence: Probe specific to human ENaC-alpha
ggagcttatagtagcagtacccctttttaggcataggacccgtgtct

SEQ ID NO: 1655 - DNA, 41 bp, Artificial sequence
  Synthetic sequence: Probe specific to human ENaC-alpha
acgctgcatggcttccgtttttaggcataggacccgtgtct

SEQ ID NO: 1656 - DNA, 44 bp, Artificial sequence
  Synthetic sequence: Probe specific to human ENaC-alpha
gagggccatcgtgagtaacctttttaggcataggacccgtgtct

SEQ ID NO: 1657 - DNA, 21 bp, Artificial sequence
  Synthetic sequence: Probe specific to human ENaC-alpha
tcatgctgatggaggtctcca

SEQ ID NO: 1658 - DNA, 25 bp, Artificial sequence
  Synthetic sequence: Probe specific to human ENaC-alpha
ggtaaaggttctcaacaggaacatc

SEQ ID NO: 1659 - DNA, 25 bp, Artificial sequence
  Synthetic sequence: Probe specific to human ENaC-alpha
cacacctgctgtgtgtactttgaag

SEQ ID NO: 1660 - DNA, 23 bp, Artificial sequence
  Synthetic sequence: Probe specific to human ENaC-alpha
caggaactgtgctttctgtagtc

SEQ ID NO: 1661 - DNA, 23 bp, Artificial sequence
  Synthetic sequence: Probe specific to human ENaC-alpha
gtggtctgaggagaagtcaacct

SEQ ID NO: 1662 - DNA, 19 bp, Artificial sequence
  Synthetic sequence: Probe specific to human ENaC-alpha
ccattcctgggatgtcacc

SEQ ID NO: 1663 - DNA, 41 bp, Artificial sequence
  Synthetic sequence: Probe specific to human GAPDH
gaatttgccatgggtggaattttttctcttggaaagaaagt

SEQ ID NO: 1664 - DNA, 41 bp, Artificial sequence
  Synthetic sequence: Probe specific to human GAPDH
ggagggatctcgctcctggatttttctcttggaaagaaagt

SEQ ID NO: 1665 - DNA, 40 bp, Artificial sequence
  Synthetic sequence: Probe specific to human GAPDH
ccccagccttctccatggttttttctcttggaaagaaagt

SEQ ID NO: 1666 - DNA, 40 bp, Artificial sequence
  Synthetic sequence: Probe specific to human GAPDH
gctcccccctgcaaatgagtttttctcttggaaagaaagt

SEQ ID NO: 1667 - DNA, 42 bp, Artificial sequence
  Synthetic sequence: Probe specific to human GAPDH
agccttgacggtgccatgtttttaggcataggacccgtgtct

SEQ ID NO: 1668 - DNA, 45 bp, Artificial sequence
  Synthetic sequence: Probe specific to human GAPDH
gatgacaagcttcccgttctctttttaggcataggacccgtgtct

SEQ ID NO: 1669 - DNA, 46 bp, Artificial sequence
  Synthetic sequence: Probe specific to human GAPDH
agatggtgatgggatttccatttttttaggcataggacccgtgtct

SEQ ID NO: 1670 - DNA, 44 bp, Artificial sequence
  Synthetic sequence: Probe specific to human GAPDH
gcatcgccccacttgatttttttttaggcataggacccgtgtct

SEQ ID NO: 1671 - DNA, 43 bp, Artificial sequence
  Synthetic sequence: Probe specific to human GAPDH
cacgacgtactcagcgccatttttaggcataggacccgtgtct

SEQ ID NO: 1672 - DNA, 46 bp, Artificial sequence
  Synthetic sequence: Probe specific to human GAPDH
ggcagagatgatgacccttttgtttttaggcataggacccgtgtct

SEQ ID NO: 1673 - DNA, 21 bp, Artificial sequence
  Synthetic sequence: Probe specific to human GAPDH
ggtgaagacgccagtggactc

SEQ ID NO: 1674 - DNA, 28 bp, Artificial sequence
  Synthetic sequence: Primer P745
ctccatgttctgcggccgcggatagaag

SEQ ID NO: 1675 - DNA, 18 bp, Artificial sequence
  Synthetic sequence: Primer P733
ccggccggcgggcgggct

SEQ ID NO: 1676 - DNA, 18 bp, Artificial sequence
  Synthetic sequence: Primer P734
ctccccagcccggccgct

SEQ ID NO: 1677 - DNA, 19 bp, Artificial sequence
  Synthetic sequence: Primer P735
ggccgctgcacctgtaggg

SEQ ID NO: 1678 - DNA, 21 bp, Artificial sequence
  Synthetic sequence: Primer P737
atggagtactgtgactacagg

SEQ ID NO: 1679 - DNA, 19 bp, Artificial sequence
  Synthetic sequence: Primer P740
ttgagcatctgcctacttg

SEQ ID NO: 1680 - DNA, 18 bp, Artificial sequence
  Synthetic sequence: Primer P715
tcagggcccccccagagg

SEQ ID NO: 1681 - protein, 669 aa, Macaca fascicularis
MEGNKLEEQDASPPQPTPGLMKGDKREEQGLGPEPAAPQQPTAEEEALIEFHRSYRELFEFFCNNTTIHGAIRLVCSQHNRMKTAFWAVLWLCTFGMMYWQFGLLFGEYFSYPVSLNINLNSDKLVFPAVTICTLNPYRYPEIKEELEELDRITQQTLFDLYKYDSSPTLVAGSRGRRDLRGTLPHLLQRLRVPSPLHGARQARSVASSVRDNNPQVDWKDWKIGFELCNQNKSDCFYQTYSSGVDAVREWYRFHYINILSRLPETLPSLEEDTLGNFIFACRFNQVSCNQANYSHFHHPMYGNCYTFNDKNNSNLWMSSMPGVNNGLSLMLRTEQNDFIPLLSTVTGARVMVHGQDEPAFMDDGGFNLRPGVETSISMRKEALDRLGGDYGDCTKNGSDVPVKNLYPSKYTQQVCIHSCFQENMIKECGCAYIFYPRPQNMEYCDYRKHSSWGYCYYKLQADFSSDHLGCFTKCRKPCSVTSYQLSAGYSRWPSVTSQEWVFEMLSRQNNYTINNKRNGVAKVNIFFKELNYKTNSESPSVTMVTLLSNLGSQWSLWFGSSVLSVVEMAELIFDLLVITFLLLLRRFRSRYWSPGRGDRGAQEVASTQASSPPSHFCPHPTSLYLSQLGPAPSPALTAPPPAYATLGPCPSPGGSAGASSTAYPLGGP

SEQ ID NO: 1682 - DNA, 3120 bp, Macaca fascicularis
gaattcgcccttggccgctgcacctgtaggggaacaagctggaggagcaggaccctagacctctgcagcccaccgcagggctcatggaggggaacaagctggaggagcaggacgctagccctccacagcccaccccagggctcatgaagggggacaagcgtgaggagcaggggctgggcccagaacctgcggcaccccagcagcccacggcggaggaggaggccctgatcgagttccaccgctcctaccgagagctcttcgagttcttctgcaacaataccaccatccacggcgccatccgcctggtgtgctcccagcacaaccgcatgaagacggccttctgggcagtgctctggctctgcacctttggcatgatgtactggcaattcggcctgcttttcggagagtacttcagctaccccgtcagcctcaacatcaacctcaactcggacaagcttgtcttccccgcagtgaccatctgcaccctcaatccctacaggtatccggaaattaaagaggagctggaggagctggaccgcatcacacagcagacgctctttgacctgtacaaatacgactcctcccccaccctcgtggccggctcccgcggccgtcgtgacctgcggggcactctgccgcacctcttgcagcgcctgagggtcccgtccccgcttcacggggcccgtcaagcccgtagcgtggcctccagcgtgcgggacaacaacccccaagtggactggaaggactggaagatcggtttcgagctgtgcaaccagaacaaatcagactgcttctaccagacatactcatcaggggtggatgcagtgagggagtggtaccgcttccactacatcaacatcctgtcgaggctgccagagactctgccatccctggaggaggacacactgggcaacttcatcttcgcctgccgcttcaaccaggtctcctgcaaccaggcgaattactctcacttccaccacccaatgtatggaaactgctatactttcaatgacaagaacaactctaacctctggatgtcttccatgcctggagtcaacaacggtctgtccctgatgctgcgcacagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaagccctggacagacttgggggcgactatggcgactgcaccaagaatggcagtgatgtccctgtcaagaacctttacccttcaaagtacacgcagcaggtgtgtattcactcctgcttccaggagaacatgatcaaggagtgtggctgtgcctacatcttctatccgcggccgcagaacatggagtactgtgactacaggaagcacagttcctggggctactgctactataagctccaggctgacttctcctcagaccacctgggctgtttcaccaagtgccggaagccatgcagtgtgaccagctaccagctctcggctggttactcacgatggccctcggtgacatcccaggaatgggtcttcgagatgctatcgcgacagaacaactacaccatcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcagtgctgtctgtggtggagatggctgagctcatctttgacctgctggtcatcacattcctcctgctgctccgaaggttccgaagccgatactggtctccaggccgaggggacaggggtgctcaggaggtggcctccacccaggcatcctccccgccttcccacttctgcccccaccccacatctctgtacttgtcccaactaggccctgctccctccccagccttgacagcccctccccctgcctatgccaccctgggcccctgcccatctccagggggctccgcaggggccagctccactgcctatcctctgggggggccctgagagaggagaggttccttgcaccaaggcagatgctcccctggtgggagggtgctgcccttggcaagattgaaggatgtgcagggcttcctctcagagccgcccaaactgcccttgatgtgtggaggggaagcgagatgggtaaggggctcaggaagttgttccaagaacagtggccaatgaagctgcccagaagtgccttggctctggctctgtaccccttggtactgcctctgaacactctggtttccccacccaactgcagctaagtctccttttcccttggatcagccaagccaaacttggagctttgacaaggaactttcctaagaaatggctgatgaccaggacaaaacacaaccaagggtacacacaggcatgcacgcgtttcctgcctggcgacaggtgaagccagcccctgactgacctggccacactgctctccagtaacacagatgtctgcccctcatcttgaacttgggtgggaaaccccacccaaaagccccctttattacttaggcaattccccttccctgactcccgagagccagggccagagcagacccgtataagtaaaggcagctccagggctcctctaggctcatacccgtgccctcacagagccatgctccagcgcttctgtcctgtgtctttcgtccctctacatgtctgctcaagacattttctcagcctgaaagcttccccagccatctgccggagaactcctatgcatccctcagaaccctgctcagacaccattacttttgtgaaggcttctgccacatcttgtcgtcccaaaaattgatcactcccctttctggtgggctcccgtagcacactataacatctgctggagtgttgctgttgcaccatactttcttgtacgtttgtgtctgcctccccaactggactgtgagggccttgtggccagggactgagtcttgcccgtttatgtatgctccgtgtctagcccatcatcctgcttgaagcaagtaggcagatgctcaaaagggcgaattctgcagatatc

SEQ ID NO: 1683 - DNA, 38 bp, Artificial sequence
  Synthetic sequence: Probe specific to cynomolgous alpha-ENac
cgccgtgggctgctgggtttttctcttggaaagaaagt

SEQ ID NO: 1684 - DNA, 40 bp, Artificial sequence
  Synthetic sequence: Probe specific to cynomolgous alpha-ENac
ggtaggagcggtggaactctttttctcttggaaagaaagt

SEQ ID NO: 1685 - DNA, 43 bp, Artificial sequence
  Synthetic sequence: Probe specific to cynomolgous alpha-ENac
cagaagaactcgaagagctctctttttctcttggaaagaaagt

SEQ ID NO: 1686 - DNA, 40 bp, Artificial sequence
  Synthetic sequence: Probe specific to cynomolgous alpha-ENac
cccagaaggccgtcttcattttttctcttggaaagaaagt

SEQ ID NO: 1687 - DNA, 41 bp, Artificial sequence
  Synthetic sequence: Probe specific to cynomolgous alpha-ENac
ggtgcagagccagagcactgtttttctcttggaaagaaagt

SEQ ID NO: 1688 - DNA, 41 bp, Artificial sequence
  Synthetic sequence: Probe specific to cynomolgous alpha-ENac
gtgccgcaggttctgggtttttaggcataggacccgtgtct

SEQ ID NO: 1689 - DNA, 42 bp, Artificial sequence
  Synthetic sequence: Probe specific to cynomolgous alpha-ENac
gatcagggcctcctcctctttttaggcataggacccgtgtct

SEQ ID NO: 1690 - DNA, 45 bp, Artificial sequence
  Synthetic sequence: Probe specific to cynomolgous alpha-ENac
ccgtggatggtggtattgttgtttttaggcataggacccgtgtct

SEQ ID NO: 1691 - DNA, 41 bp, Artificial sequence
  Synthetic sequence: Probe specific to cynomolgous alpha-ENac
gcggttgtgctgggagctttttaggcataggacccgtgtct

SEQ ID NO: 1692 - DNA, 45 bp, Artificial sequence
  Synthetic sequence: Probe specific to cynomolgous alpha-ENac
ttgccagtacatcatgccaaatttttaggcataggacccgtgtct

SEQ ID NO: 1693 - DNA, 17 bp, Artificial sequence
  Synthetic sequence: Probe specific to cynomolgous alpha-ENac
acaccaggcggatggcg

SEQ ID NO: 1694 - DNA, 37 bp, Artificial sequence
  Synthetic sequence: Probe specific to eGFP
ggcacgggcagcttgctttttctcttggaaagaaagt

SEQ ID NO: 1695 - DNA, 40 bp, Artificial sequence
  Synthetic sequence: Probe specific to eGFP
ggtagcggctgaagcactgtttttctcttggaaagaaagt

SEQ ID NO: 1696 - DNA, 40 bp, Artificial sequence
  Synthetic sequence: Probe specific to eGFP
cctggacgtagccttcgggtttttctcttggaaagaaagt

SEQ ID NO: 1697 - DNA, 42 bp, Artificial sequence
  Synthetic sequence: Probe specific to eGFP
ccttgaagaagatggtgcgcttttttctcttggaaagaaagt

SEQ ID NO: 1698 - DNA, 39 bp, Artificial sequence
  Synthetic sequence: Probe specific to eGFP
cgaacttcacctcggcgctttttctcttggaaagaaagt

SEQ ID NO: 1699 - DNA, 39 bp, Artificial sequence
  Synthetic sequence: Probe specific to eGFP
ccttcagctcgatgcggttttttctcttggaaagaaagt

SEQ ID NO: 1700 - DNA, 42 bp, Artificial sequence
  Synthetic sequence: Probe specific to eGFP
gtcacgagggtgggccagtttttaggcataggacccgtgtct

SEQ ID NO: 1701 - DNA, 43 bp, Artificial sequence
  Synthetic sequence: Probe specific to eGFP
cacgccgtaggtcagggtgtttttaggcataggacccgtgtct

SEQ ID NO: 1702 - DNA, 44 bp, Artificial sequence
  Synthetic sequence: Probe specific to eGFP
gtgctgcttcatgtggtcggtttttaggcataggacccgtgtct

SEQ ID NO: 1703 - DNA, 42 bp, Artificial sequence
  Synthetic sequence: Probe specific to eGFP
tcaccagggtgtcgcccttttttaggcataggacccgtgtct

SEQ ID NO: 1704 - DNA, 21 bp, Artificial sequence
  Synthetic sequence: Probe specific to eGFP
cggtggtgcagatgaacttca

SEQ ID NO: 1705 - DNA, 21 bp, Artificial sequence
  Synthetic sequence: Probe specific to eGFP
catggcggacttgaagaagtc

SEQ ID NO: 1706 - DNA, 21 bp, Artificial sequence
  Synthetic sequence: Probe specific to eGFP
cgtcctccttgaagtcgatgc

SEQ ID NO: 1707 - DNA, 20 bp, Artificial sequence
  Synthetic sequence: Unmodified control sequence DI_A_2216, a single-stranded antisense DNA molecule
  misc_feature 1, 2, 15..19: g is guanosine-5prime - phosphorothioate
gggggacgatcgtcgggggg

SEQ ID NO: 1708 - RNA, 23 nt, Artificial sequence
  Synthetic sequence: Unmodified control sequence DI_A_5167, a cholesterol-conjugated siRNA
  misc_feature 21: c is cytidine-5prime - phosphorothioate
  misc_feature 22: a is adenosine-5prime - phosphorothioate
auugguauucagugugaugacac

SEQ ID NO: 1709 - RNA, 21 nt, Artificial sequence
  Synthetic sequence: Unmodified control sequence DI_A_5167, a cholesterol-conjugated siRNA
  misc_feature (21)..(21): terminal u linked to a cholesterol derivative
  misc_feature 21: u is uridine-5prime - phosphorothioate
gucaucacacugaauaccaau

SEQ ID NO: 1710 - DNA, 27 bp, Artificial sequence
  Synthetic sequence: Primer P713
atggatgatggtggctttaacttgcgg

The invention claimed is:

1. A composition comprising an iRNA agent comprising a sense strand and an antisense strand, wherein:
   a. the sense strand comprises at least 15 contiguous nucleotides from the sense strand of ND8453 (SEQ ID NO: 1425), and the antisense strand comprises at least 15 contiguous nucleotides from the antisense strand of ND8453 (SEQ ID NO: 1426); or
   b. the sense strand comprises at least 15 contiguous nucleotides from the sense strand of ND8489 (SEQ ID NO: 1497), and the antisense strand comprises at least 15 contiguous nucleotides from the antisense strand of ND8489 (SEQ ID NO: 1498); or
   c. the sense strand comprises at least 15 contiguous nucleotides differing by 0, 1, 2 or 3 nucleotides from the sense strand of ND8456 (SEQ ID NO: 1431), and the antisense strand comprises at least 15 contiguous nucleotides differing by 0, 1, 2 or 3 nucleotides from the antisense strand of ND8456 (SEQ ID NO: 1432).

2. The composition of claim 1, wherein the antisense strand is 30 or fewer nucleotides in length, and wherein the sense strand and the antisense strand form a duplex region 15 to 30 nucleotide pairs in length.

3. The composition of claim 1, wherein the antisense strand and the sense strand are each 19 to 23 nucleotides in length.

4. The composition of claim 1, wherein the iRNA agent comprises a modification that causes the iRNA agent to have increased stability in a biological sample.

5. The composition of claim 1, wherein the iRNA agent comprises a phosphorothioate or a 2'-modified nucleotide.

6. The composition of claim 1, wherein the iRNA agent comprises:
   at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide.

7. The composition of claim 1, wherein the iRNA agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), dimethylaminopropyl (2'-O-DMAP), 2'-O-dimethylaminoethyloxyethyl (2'-O-DMAEOE), and 2'-O—N-methylacetamido (2'-O—N-methylacetamido (2'-O-NMA).

8. The composition of claim 1, wherein the iRNA agent comprises a blunt end.

9. The composition of claim 1, wherein the iRNA agent comprises a nucleotide overhang having 1 to 4 unpaired nucleotides.

10. The composition of claim 1, wherein the iRNA agent comprises a nucleotide overhang at the 3'-end of the antisense strand of the iRNA agent.

11. The composition of claim 1, wherein the iRNA agent is ND8453 (SEQ ID NOs. 1425 and 1426).

12. The composition of claim 1, wherein the iRNA is ND8489 (SEQ ID NOs. 1497 and 1498).

13. The composition of claim 1, wherein the iRNA is ND8456 (SEQ ID NOs. 1431 and SEQ ID NO: 1432).

14. The composition of claim 1, wherein the iRNA agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, Oligo Lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

15. A method of treating a human subject having a pathological state mediated at least in part by alpha-ENaC expression, the method comprising the step of administering to the subject a therapeutically effective amount of a composition of claim 1.

16. The method of claim 15, wherein the pathological state is cystic fibrosis, primary ciliary dyskinesia, chronic bronchitis, chronic obstructive pulmonary disease (COPD), asthma, respiratory tract infections, lung carcinoma, Liddles syndrome, hypertension, renal insufficiency, and/or electrolyte imbalance.

17. A composition comprising an iRNA agent to alpha-ENaC, wherein the iRNA agent comprises a sense strand and an antisense strand, wherein the sense strand comprises at least 15 contiguous nucleotides differing by 0, 1, 2, or 3 nucleotides from the sense strand of an iRNA agent selected from the group consisting of ND8453 (SEQ ID NO: 1425), ND8489 (SEQ ID NO: 1497), and ND8456 (SEQ ID NO: 1431), and wherein the antisense strand comprises at least 15 contiguous nucleotides differing by 0, 1, 2, or 3 nucleotides from the antisense strand of an iRNA agent selected from the group consisting of ND8453 (SEQ ID NO: 1426); ND8489 (SEQ ID NO: 1498), and ND8456 (SEQ ID NO: 1432), the composition further comprising an epithelial receptor ligand.

18. The composition of claim 17, wherein the epithelial receptor ligand is transferrin.

19. The composition of claim 17, wherein the epithelial receptor ligand is folic acid.

20. A method of treating a human subject having a pathological state mediated at least in part by alpha-ENaC expression, the method comprising the step of administering to the subject a therapeutically effective amount of a composition of claim 17.

21. The method of claim 20, wherein the pathological state is cystic fibrosis, primary ciliary dyskinesia, chronic bronchitis, chronic obstructive pulmonary disease (COPD), asthma, respiratory tract infections, lung carcinoma, Liddles syndrome, hypertension, renal insufficiency, and/or electrolyte imbalance.

22. A method of treating a human subject having a pathological state mediated at least in part by alpha-ENaC expression, the method comprising the step of administering a therapeutically effective amount of a composition comprising an iRNA agent to alpha-ENaC, wherein the iRNA agent comprises a sense strand and an antisense strand, wherein the sense strand comprises at least 15 contiguous nucleotides differing by 0, 1, 2, or 3 nucleotides from the sense strand of an iRNA agent selected from the group consisting of ND8453 (SEQ ID NO: 1425), ND8489 (SEQ ID NO: 1497), and ND8456 (SEQ ID NO: 1431), and wherein the antisense strand comprises at least 15 contiguous nucleotides differing by 0, 1, 2, or 3 nucleotides from the antisense strand of an iRNA agent selected from the group consisting of ND8453 (SEQ ID NO: 1426); ND8489 (SEQ ID NO: 1498), and ND8456 (SEQ ID NO: 1432).

23. The method of claim 22, wherein the composition is administered in an amount sufficient to reduce the level of alpha-ENaC expression in a cell or tissue of the subject.

24. The method of claim 23, wherein the pathological state is cystic fibrosis, primary ciliary dyskinesia, chronic bronchitis, chronic obstructive pulmonary disease (COPD), asthma, respiratory tract infections, lung carcinoma, Liddles syndrome, hypertension, renal insufficiency, and/or electrolyte imbalance.

25. A composition comprising an iRNA agent comprising a sense strand and an antisense strand, wherein the sense strand comprises at least 15 contiguous nucleotides from the sense strand of ND8453 (SEQ ID NO: 1425), and the antisense strand comprises at least 15 contiguous nucleotides from the antisense strand of ND8453 (SEQ ID NO: 1426).

26. A composition comprising an iRNA agent comprising a sense strand and an antisense strand, wherein the sense strand comprises at least 15 contiguous nucleotides from the sense strand of ND8489 (SEQ ID NO: 1497), and the antisense strand comprises at least 15 contiguous nucleotides from the antisense strand of ND8489 (SEQ ID NO: 1498).

27. A composition comprising an iRNA agent comprising a sense strand and an antisense strand, wherein the sense strand comprises at least 15 contiguous nucleotides differing by 0, 1, 2 or 3 nucleotides from the sense strand of ND8456 (SEQ ID NO: 1431), and the antisense strand comprises at least 15 contiguous nucleotides differing by 0, 1, 2 or 3 nucleotides from the antisense strand of ND8456 (SEQ ID NO: 1432).

* * * * *